United States Patent 9,567,581 (SELECTIVE REACTIVATION OF GENES ON THE INACTIVE X CHROMOSOME) - sequence listing, part 25

SEQ ID NO: 3315 - DNA, 1338345 bp, human
gaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagagattttttttctgccatgtgttaatcatattatggttaggtggtaaatacgctgcatatgttcttattaattatgttctttttaataaggtaaaatggttatgtttcttttttcttacggatttagggaatataggtcagtaaaaacaacagaaatcatctgatcaaaacctcagagtgttctcagcataagaaagaactttctatactacttttgaatgactttggcatgatacaaaatggaaacaattgctctaaaggaatagactgagctccctgcatagtgtagtttgtcaagtcctgggaatagtgttgtctatagacgccaaggagcctgttgtttcctgcttagcagaacagcttgcatttgaaaagaaagcacaagatgaaaacattgtgaccaaagggcatcttcctatgtgtagagctcaaagactaaaagttggtttgtcacatcactaaccaagaacatgagttgatatggtaacaagaattaaaattatttactccatattcaaggatgaattttaaatataaattataagtctaattttataagcaaaagtcctcaaagagttgttcaaatagtctttaaaaggtacttttaaaaatctatagcaatttctaaaagttatataacttacacattgatgactacaatcataaaacccaaaacctagatcaagaaatttctagcactccagaaggcttcctcattccccttccttaaagataccatgattctaacatctgtcataatagatcactttttaaaagttcatatttggctgtggccatatggacttgcctttttatttatttatttatttatttttatttatttattttttttatgagacagagtctcgctctgtcacccaggctggagtgcagtggcacgatcttggctcactgcaagctccgcctcccgggttcatgccattctcctgcctcagcctcccaagtagctgggactacaggcgcccgccaccacacccggctaattttttgtatttttagtagagacagggtttcactgtgttagctaggatggtctcaatctcctgacctcgtgatccgcccacctcagcctcccaaagtgctgggattacaggcgtgagccactgtgcccgaccaagtttataggttttagaagcccatgctgtagcaggcaagtgataacaggctttaatccccttaaagcctgttgtgggatgggatactggcattgagtggggtaagggtgattaggttttaatgggagagtaatgggtgtgtgatcggttgccagggagggagtagaggtgtctcatacttgtgggttaaggtggggggatacgagaggaagacgtgaaggaggctttgggtttagaagaagggtggcaatgagatgtggctgtagtccaggaatagtcagggaagcagataatttggttaaaatgtctcggcctaataagggaactgggcaggtggggataactaaaaaagagtgcataaaagaacgttgtccaagttggcaccagagtaggggagttttaaggggttttgaagcttggccatcaatacccacaacagttatgggggcaagggaaacaggcccttgaaaagaaggtaatatggagtgggtagcccctgtattgattaaacaggggatggacttaccctccactgtgagagttactcgatggtgtccgtgatggtccagggggcttccaaggcgatcgggcagcgtcagtattcagctgctaagccaaggagatctgggaaggagtcagtcagacagccttgggccagagttccaggggctctgggagtggctgctgggtgagttggacagtccgatttccagtggggtcccgcacagatgggacatggcttagggggaatcctgggctgcgggcattccttggcccagtggccagatttctggcacttgaagcaagatcctgatggaggaggtcctgtaggaatgcttgaccgctgcggcttaggcatgtgaggcttaggcattttgaagttcttgtgcactggaggtgcggctgggttttgtctcacagcagaggcaagtaattgtaactcagaaatgcgttgctgtctggctgtctcctctctattattgtacaccttgaaggtgaggttgattaattcctgttgtggggtttgagggctggattctaatttttgaagcttttttctaatgtcaggagctgactgggtgataaaatgcatatttagaatgacacggccttctgacccttcagggtctagggctgtaaagcatcttagggttgctgccaaatgagccatgaactgggctgggtttttatatttgatgaaaaagagcctaaatgctcattgatttgggagaggtcggataaagaaaaaggaatattatccttgactatgcctttagctccagccacctctttaagaggaaattgttgggctgattggggagggctagtggcagaacgaaactgtaagccggactgggtgtgaggaggggaggtgatagaaggattatagggtgggggagcagaggctgaggaagaattggagcctgattcagcctggcagggagcgacctgaggaggagcagtctggggaggaggggagaggtcagatgggtcggtagaaaaggaagattgaaaagactcgtgatgcttggggttgggacctaggggacaggcgggagggaaagaaggaagatttgggatgagttgcattgggaacagagactagggaggggccgatgtgtaaaagaatgcctggatatcaagcaccttagaccatttgcccattttatgacaagaattatctagatcttgtaggatggagaaattgaaagtgctgttttctggccatttagagccattatcaagtttgtattggggccaagaggtgctgcagaagaaaataaggcatttaggttttaggtcaggtgtgagttgaagaggttttaagtttttgagaacacagactaagggagaagagggaggaatggagggtggaaggttgcccatagtgaaggaggcaagcccagagaaaagagagggtagagacacgcagagaaggggtagagggtgcttgccccccaggaaagtggtgcttgccactaaatgtgaaggatcaaggcaggtgtgcccatggtgattaggcacctctgaatcatgggtgaataatcaagcaggcatccccacagtggttaaacaccaagggaagactgtcttcctgagtccatgaccggtgccggagttttgagttcacagataaaacgcgtctcttctgtctctaccagaaaaggaaaggaattgaaattaacagaagggagagattgaagggtggtgccaagattgaaaggagaaagaggttgagggatagtgagagagggtggagaagagagtaaaaagaggctgcttacccgatttaaaattggtgagatgttccttgggctggttcgtctgaggacctgaggttgtaggtggatgtttctcacagagcaaagagcaggaggacagaggattgatctcccaagggaggtcccccgatccgagtcagggcaccaaatgtcacacgtgtccatgtgaagagaccaccaaacaggctttgtgtgagcaataaagctttttaatcacctgggtgcaggcgggctgagtctgaaagagagtcagcaaagggaaataggggtggggctgttttataggatttgggtgggtagtggaaaattacagtcaaaggggggttttctctggcgggcaggggagggggtcacaaggtgctcagtaggggagtttctgagccaggagaaggaatttcacaaggttaatcgctcagttaaggcaagaaccagccattttcacttcttttgtgattcttcacttgcttcaggccatctggatgtatacgtgcaggtcacaggggatatgttgtcttagcttgggctcagaggcgtgacagcagctttcaaaaccctttgtaatctggtcccgtgagtttatctaaccttatttctttctacagtccagataatagatatttataaaattcctattttgtgtgaaacactgagattagaaagtaatagtgtctatagcctttgtccctgggaatttttcaatcagaccgaaaatggtatccttctaatcttctaactagttgtctaaccttaagctcccagagattcttcttgcctaaagtcccatggtacttaacatctttattagtctatgctatgatttttttaagtttttagcaatgagacctaactgtgaaacaattttcatggaactctaatgtattacacagatgggaatgttgttgactacagaagtgtgaagcttgaatcccaccatctgtgacctttctcatcagccctgcttatttcaggtcagtccaagtcacctctccaaaccataaaattggatgaacataattgaaaagccactgtaatataacatctcctattggtatccaatttcatagctccttatcttaacacttcaaaaaagtcttcagaatctcctccactaatatactgcttggggttcaaaacgttctttttaatccagttgttcctaactcgcaaacatagcacactggctaccaacatacactgtaataattatgttaatataagaaagaaccatgaatgttaatggttctgattctttgtttatatcatttctatcatcaccgagtttaccccttgtcagcttgtcacccataaacatctccttaaaccatatttaatctctaaataaagacaataataaggtcataattccatctaacatccaactatactgggtacaacccaaaatacactaaccccttccccaaaagaggaggcaaagtccttgattgatgtttattcttctccctgatatcctataacttaaatactaagatataaaattagcaatacttaaatgctatgatacaaagtaatacatcttacatgataaggaaatgaggaaagaaaacaaaggtatttgcttaacacaaacacacacacacacaaatgtatttgttacaaactaaggaggaaatactcatgacaattggaatcctcattcctataactggtcacatggttatgcatgatatttataactaccttcttccactacccattctgttttccctatgccttcaacaagcacctctgctggttgccatacgttacctgataaggtaaaccaaatcttcattcctgaagtgtctgggccattaggagtcctgcttgaattgggctgttgtagtttttcatctcctgcattccagacatactcttccttacttccattgtggggtagtactccggtttgcccttggtagtcaggatcaatcacctcagccagcacagaaactcccttctttgcctgtagattagagaaatgaggagcacaaagtggccaggaagcactcttaacttccattcaatggtatcattgttgtgtctctagatggaagcatttttccctctggaactaagacctctaggctagcaggggttaaggtggtggaaacaggaaacaaaaatgttgctagcaggttgctgttggtgatagtgagtggtgccactcccatttccttgacttgattcttggagacatgaatcttggctatgggagaaacagcagcatatattggatgctgagtagaggccttctggaaaacctatcctcagctcttcaaggtattgccacctagctggcactgtaaggaagtcttcaaaaggccattctaccattgtatcagctgtttcaggatggtagagaacatggtaacatgagtgaatttcatgagcacgggcccattgccacacttcttttgttacaaagtgaagttctaaatcagaagcaatgccgtgtggaaaccatggcagtgtgtaaagcattctgtaagtccatggatggaagcaaatctgtatctaatgtaagtgctattccagtaagaacaaaaggctgttccttccttggtagaagtggtccaatgtaatcaacctggcaccaaggagctagctgatcaccttgggaaatggcttcaaaccaggggctcagtgtttgctgctgggagattgggctctcagtcatggctatagccaggtaagccttggtgagtggaactctacattgctgagccaatgtataacctgcatctctgccactatggccactttgttcatgagcccactgggcaatgacaggggcagctggggaaagaggctgagtggtatccatagaaaaggtcatcctatccacttgattattttgagtcctactctgctgaggtcaccctttggtgaacattcacatgggacacaaatatcttcacatttcttgcacattgagagaggcttattcatataacctcttttccaaattttcttctcactaattttccaatcatgttcctttcaatctctcatcattcaaccagtccattggccacagggaataaatcagtatataatcacatctggacatttctctttctaagcaaagtgaacaaataggtttgttgcttggagttctgcagactaaggatttcttttcatgagtgtctttcaggaatatcccagaaaagggctatagtcctgtagctgttcagtttggggtggtgcctggatattgtgcagaatcatctataaacttagcctagtcttcttttcctctgtcaactaagtgtgaggaattcaccatgaggccatgggtgcaggctgagagtgagaaggcagtgtagcaggagtgaggaacatgggcatttggtccacttcttcatgtaacttacttatgccttcagagtccattcagctcgatcacatatataccacttccaactgatgatgcagacagtcctgctgtgcacacccaactttatggtttggtgggtcagataacacccagtttgtgataggcagtttaggtcgcatggtcacttggtgacccatagtcaaatattcagtttccaataaggcccagtagcaggccaagggctatttttcaaaaggaaagtagatacctactctccttttaaaatagtgggtaaaagagcagagggtggcacgtgtgctccaaaatcccaagggtcttctctgtgtttcactcatagaggcctgccaaaggatccaaacagcatttttatctgacactgataccaagcaccattggatctgctggatcatatggcccaagagcagagtagtttgcagatcagcctgaacctatggcagagccttctccttttctgggccccactcaaaactagcagctttttaggtcactcagtacttgagttgaagtaacacacccaaatgaggaatatcatttgggtattcctccaaatccaaagaggcctacaaggcattatgcctcttttgttgttgttgttggggccagatgcaacaacttatcccttaccttagaaggaatatcttcatgtcccataccactggacccctagaaatttcactgaggtaaaaggacactgaattttagttggatttatttcccatccactggcacgcgaaattcttaccaataaccctagagtagttgctacttggtgctcactaggtcctcaatataatggacaagtgtgatatcttgtggaaggaaaaggcaatcaagagccctgagaatgaaattataacatagggttagagagttgatatacctctgatttaggacagtgaaggtatattgctggcctttccagctgaaagcaaactgcttctggtgggcatatgggcagtgaagaaagaaaagcaattttatctgaggaatgtgagccattttaaattatcaggtccagagaggcattaaattgagacagcagtcataccctccttcccccattgagctatgtattcatctcttgaaatataaccaagcccttattataaagatcataagatgtttgttttatttattgtcttttttctttgtcctcttccttatccatgcatgcttgcttgtatctagtcatttctatagagggtggacattagttattgataaacttgaaatcctgacccctggagctaccctcagaatcgatgaacttgtttttcttttaaagaacagtgatccataggtcatgcagacctccttgatgacatccacaagtttgattggaactgatgagatctagattccagggagtgcaaagagatttgatcattgggggatcccacctcctacattcttaccttactcataaaagtccccagttatttcaaaggcaggtcagatttgagactgtctcacctgccctctcactttggccaaattgaataaacctttctctgctcctaagcactgatatgtctgtgtttggcttaatgtgcatcaggcacgtgagcctaaatttcaggaatcgataacagattttgatgactgcagcaggacacatgtgctcatggccagtaggtcccagtcaggttgggcaaatgggcatccacacagctgcctgggtgtgttgcttggggtaagccctggggtcacccttctcagtaggtgtcagctgcccttggcaccctaggagcttggagcagagaaacaccttggactgcttcctcaattttcagttttgatttgaagggcaagttgttacacatgcgcaaccaaatctctcattctctccatttgtattttgaagagagcccatttgggagagtaagtagaatggtagcctatactgatttgcttgtttgtgtacctgcagtagtttggttttgtgtgtgtgtggaaggattgaatgtgggaaattcaggatcaatctcagagtgcagccttctttggctgtgttttccagaattgggccactttcagctaggagtccatgaggaaaaagaaaatgttttcattattattattacactgcttggcctcaatatgccttagattctggggtaaagtggcttgtgaatgggtctttaaattatgttactataatgcaactagaactgttttgtaagagggagagaaaatgggatgagatcccatatgttcggatttttatgcttttgtgtcagaataaacctgctcaaaaaaggtgtagtataacttgatgccgcaaaaggaagaatagcccaaacctaaggttttagactttccaccattagatgtagaggacaaggtgctgatcagcaccttgaatcccccaaataatcatcctggtcctctgccccttcctctgccacctgtggctccagcacatccccctccttatggaacatgtggagcaggaggaggacacccccaatccctcatgggggaaaaatcaggataggttatgaattcttcttcttgtacctgacaggtaacaaaatttggccagtgagccacaggcccctaggtagggcagtttcctctctgctaatcccctgttaggataatgtgaatgagcatttggctgatatgatgtgggtgcactccacttttcccacttcagatctgttcaattggaaaagcaataatccctccaatcaagatgaccccaagtaaatagctgagcaattctcatccatacttctgacctattatcccacatgggcagatatccaggctttgttaaatgtactgctcacagcaaataaaaggaacattgtcatagaaaaaaactaaagaggaagcaacctggctccatcttgaggatggaaataatctccctgagccaatgcagtcagtccgcaccacggaacccagttaggatgtaaataatggaggtcttccccacttagagcactattaaagttgtatccttgaaggtttaaagaaaggggtccctccaagagccttaataaagtacaggaggtacagcagcaaccaaatgaggccttcacaattcttggaaagactatcagacatatcaaaagtttgcaggtggaactggaaaatcagagaatggttaatatgagcttcatctgtcagagtgtccctgatagtcaaagaaaattgccaaagatagatgaagccattgtgttgccaaacacatttagtctagttagcttttagggtgtactatgcttgggttaaggatcaggaaaagcacaagttaaagcaacaagtatccatgttggtgatggtgcttgactttcaacctaaaagaaatgaaaaaaatcaaagcaaaaggaggatccaccccaccttagggaagaaccagtccacttattgtaaggaagaaggacatcggaaaaagggccatcccaaactgaccaaagtggctgtcaagcccaactctccctcagaatcagatgatgggaaggggaaaagactgagatgaaagttgatacagcccaaggtgtccctgagactttgaatgaccagtacctgtatccccacaggaacccaagatacaattgacattggggaacagaatgattgatttcttaaatgataagttgccacatgatcagtaattaacatttgtctcttcccaattatgggagaaaccaagattgttatggggatattggaaggtgccattatttgcccctttctacaacccttagattgccatttaggagagaccagcctgaaacagtttcctgtatgtgcctggattcccagtgcccctcctgggccaggatttgcttgccaaattgtgtgctcaatttgtcttttcctccagacacctagacatagggattcctcctgaacaagcttgcaggtttcaaaagctccaactccaaccagaaaatacagaagtttaggacattccagagaaaattctcatgaggttagaggccctcttagcgcagtgggcagcgcgtcagtctcataatctgaaaattctcatgaggctaagggaagatatttgggcttcagggaagctggggagaatggtcacagccaagcttgtaaaaaataaatgagggacacagaatacctaatctaaaacaacacccattaaaggaggcagtatgaaagggcattcagctgctcttggaagcctttttgggacaaggactaattcagccctgtcacttcccctacaacactcctgtcttgctggttcacaagccctgttcagctgactactggcttgtgcaagacttcagggttattcatgaagtagtccaggacatacaccctatggtacctaatccctatactttgctgacaagcttatcaggagataagacaaggtaaatcattacatggtttataattttggatctgaaagatgccttcttttgcatactgctagatacggagtcacaagaggtctttgcatttgaatgggcaagaccaggaatgcaggtgaattagcagtactgttggagagtgttatctcagggatttttaaaatttacccgcaacctttgggagaattttggcatgggacttaagggatttctgaccgaaagaagaatgcttttacaagatgatacctttgtttctagtaagactcttagagattcccttgaaaataccatccaaatactgagttttctaacaaaaagaggctatcagatttccaaaagaaaaagcccaaatctcccaagccctgatctccaaatacttggagtttgaaccaactaagggacaaagaaatcttctcccagactgctgagaggcaatagcctgggcagccgtccctaccgcctgcaaacaactgtgaggttttgtaagtatagtaggattttgttgaatttagattccaaattttgaacttacagtaaaacctctttatgaggtcctaaagggaaaggaatctgaacccttggtcaggacctcagaatgccaacattcttttaataaagccaaagaaaagttaatgactgctcctgcactgggtcttccaaatgtcagaaaatttgttgatgtatttgtgcatgaaaaacaaggcatgagcttgggagtcctaactcaaagtttgggaccttactggagatcaattgtttatttcactaaatagcttgatcaggtggtgaagggttggcttccctgcctccaagcagtagttgcaacttgttacctcctctaggaggctgaaaagttaactctcagacagccatcaccattcacacactgcatcacatcctccctctcttacagcaaaaaggaggggtattagctgactccagagaggttagggaaatccaggctatgttcttttacaaaccagagttaaaaataaaggcggtctcagttcttaacactgctaccttaaagcctacagaaacggagccagggctacacctaattttcttcagaatattcagcagatcttttccagctgaccaaacgtggtgtattagcccttggcacatcctgacctgaaactgttcacagatgaaagcagcttcaaggaccatggaagtcatcatgcagggtatgtgtggtcggtaccttacaaggcactgtgaaagccaaagccttattgccagacacctcagtacctcagctcaacagcgtgagctcattgccttactcttgtcatccaattggataagaacaaaattgggaatatttatatagactctaaatatgctttctctgtggcacatgcccatggggctatttagaatgagagagggcctttgactagtgataacaaggaaatcaaatatgtctctgatattttggccttataagaatctgtaaatgcccccagagtggtggctatcatccactatcctagccatcaaaaaggggaaatcaacatgccaacctggcagcgaaacaggctgcaaaaacattggactttgaggccttcttagccctgtttgtatcgcaggttgatcttactaagtaagtctcaaccttgctatactgaagaagacttaaagtggcccaaggattggggatttacgtccccagccccaggccatccaggctagatatgtaatttgggaggcattatattggttcctggagccctccttaaagatacagtgagttggctggcgcagtggctcatgcctgtaatcccagcactttgggaggccgacacaggtggatcacttaaggccaggagttcgagaccagcctggccaacatggtgaaacgctgtctcttcaaaaaatacaaaaacactagccaggcatgggatcacttgaacctggaaggcagaggttgcagtgagccgagattgcaccaccgcactccatcctgggtgacaggacaggactctgccaaaaaaaaaaaaaaaaaaaaagtagtgagcaagtttcatcaaagcacccattacagaaaagatgcaaccctttaatggctacgttagtacttgattagtcccaatatgcaatgggtaatccaaaatatgatccatcagtgcactctctgtgctcaaaaccatcctaaaattggacccgtaccccctgttcaggggactcttgaggagattctccatatgaggattggcaagttgatttcacaacaatgctgtgagtgcccaaaggctatagatatcctttttttttttttttgtatacacatttacgggatggatggaggcgtaccctacccgaaatggcccacagcttacttaaagagataatcccctggtatggactccctttgatattcagagtgacaacaacacaacatttgtctctcaggtagtacaggaaatgtctcagatcctagacactgaatagaaactttacacagcatggtgtccacaatccacaggaaagactgaaaaaaatgaatcatactataaaaagaacaattgctaagatgtgccaagaaaccagtctaacttgggtcaaggtactgccctctgccctgctgagaattcaggttgctccctaaagtaggctccaattgagtgcttttgaaattaaattgccaaattaaaaagtaacctctgttcaagagtttgcttctgacaggttggccttccccatggacatgccacttcaccctttccaggccagagaccaagtcctactcaagacctggagggaaactggactggatcatcaactggtccctcaatgggtaggaccctatgaagtcctcctgaccactcatttatctatcaaattggctgtggttaaactttgggtacattatacccacaggtaaagattgcccctcctcagctcaatgtgtgaggtaatcaacctaaatggacctgtgaaccaactgaaaacttgaagctgctctttaaggaaaactttgcaaataagtaaggccttctatcatttaattatgatattcttgctaatccccataataatatatgggcttatggtgtctcctgaaacgaatcttttcctacaatgggcacagcattatacagatagcctacaacaggaagcttgtggggtttgtgggctgctacctatatctagcatttctggattaccttggtgggtctcacctctacaaggaaatgactgagtacatttacaaaccttaatgaaaaacaatttacaagaaaatcaggtccctggtgttctaacacaagaaaataaaaggttatggcctgtcattaatgtaaccctccaaaacccaggtcacagaaaaccttttactatgaatcagactattcgacaaacttctgaatatgctgctcctctcctgaatgagttcttggcaacccccaaagttttgactattaacagtcactatactgaggaaggtttctatttagtttgggatgatttcctttggatgacacccaccaccagctacttaaatcaagttgacaccttaggaacaaaaaaaataactcttatgatcattgcccaaatattaatatgggctggatgcccccacaacaatgtcaacatactctagtgctgcaacaaactgactggttttctactgattggacacagaggctaggaattcgatgactagccccaaatggaactaaatggctatgtgacactgatctttggccctgactaccttattgaatggatagaatggtgcaccctgggtttcccttgggtccagtttcatttggaaaacacagatggacagcctgcagatctccaatatgtgttgtaccaatggaccaggttggtttccactgttatgaccatctcctatccatttctgttccctaagttagtttagaaaatgttatctggcataccaggaccctctcaaactatatgcagcatatgctaaagaatgcattcagaggcatctctttagtgacctctgaaatgaccatgatgagaaaggcaatcttgcagaactgcatgaccctcaatgtcctcacagctacacaaagggaaacctatgccataatcaaaaacaaatgtcttgtatacatcccagacaatacaggaaactttaaagatattcacaaattaataccatgtctgaccccatgatgttgctaaaccaatggttatcttcttggtgcaactctatactctcttgatggaaaaaattaataattctagctttgattataggaataggcatactcctttgttgtggattatattgctgctgcactatatgtataagatttcaaaatcacctctctcagaggatcctaacaccttgttcaatgatactgcaaagaattgcttctgtaagtcccagaacacatgaatgttttcacctgcaggtaaataagggccattccctggacccctagcaatggcccttaccagcaggaaatagttacaatgaatcaacataccaactcctcaagattgagaaatggaacaatgacattgaggatgttgtaaccgagcccttattttaagtatcaggttgttttacttagtctcctttgtctttgtccttttcctcatccgtgcatgcttgctggtacgtaatcatttctgtagagagtaatcactagtaattgattaacttcatatcctgaaccccggacctgctctcaagattgatgaacctgtttctatttcaaagaacaatgatccttaagtcatgcagatcttgatggcatccaaaagtttgatcgggactgatgacatctagagtccgaggggcacaaacaactttgatgatcccacctcccgcattcctaccttattcatgaaatcctccaattatgttcaaaggcagatcagatttgagagactgtctgtcctgatctcttgctttggctaaatcgaataaaccttcctctgctcctaagcactgatgggtcagggtttggcttactgtgcattgaatacgtgaaccaaaattttgggatttgatgacagaaactgcttgctattgccacaagtagctacaaattaacaatactgcacaagacaagataacccaagccttatagattaacaatatatagccaatcactaaccaatattatttctataaaccaaagagaattcctgacaaacaactttgtatcagcccactctctgtcccccttttttgcctttaaaaatctgcttgtacacaggcaaccaaagcaaaaatgtacaaatgggatcacatcaagttaaaaagcttttgcacagcaaaggaaacaatcaacaaagtgaaaagacaacctacaaaatgggagaaaacatttgcaaactacccatctgacaagggattaataaccagaacatacaaggaactcaacccacattataggaaaaaaatctaataaatcaaaaaatcacaaatgatttgaatagtcatttctcaaaagaagacatacaaatggcaaacagggatatgaaaaaatgctcagcatcactgatcatcagagaaatgcatatcaaaacaacaagatatcatctcaccccaattaaaatggcctatatccaaagacaggcaataacaaatgctggtgaggatgtggagaaaagggaactctcctacactgttggtgagaatgtaaattatcacaaccactatggagaacagtttggcagtttctcaaaaaactaaaaatagagctaccatgtaatccagcaattctagtgctgggtatatactcaaaaggaaaaaaacaaaaacaaaaaccaggatatcaaagagatatctgcactcccatgtttgttgcagcactgttcacaatagctaagatttggaagcaacataagtgtccatcaacagatgaatggataaagtaaatgtgatctatatgacacaggagggaaaaagaaactatttaggcagataatgagggcaaagagtcctcagcagaacttcccttctaacaaaaagcagcccaagaaatcacttcttttctaacaaagagcagcctggaagatcgggctgcaaacaaggataaggaggctggaagcttgcactgaggggtatgccagcagctgcacggatagaaggggctacctgggaccaggcatgttcaccatgggagtttcactgccccttttttagcacatgcacagtaagaaacaagcaacatggagtagctcaggctgaggactcacctgcataataaaaggttggggtgagggctgccagagattcccaccatatgcagatggcacacatggtcctaaccggtttttcgtgccctatgtagatcagataccgcctccccactagctcatctataaaaacccctgcatttcactgtgggacggcaaccctttttccaggacccttctctgtaccaaacaactgttctctttctcctattacatttctgctctaaacctcatatttggtatgtccacgtccttgatttccttggccatgagatcaagaactctgggtgtcaccctagacaatgaagatcattatgttaagtgaaataagccaggcacagaagcacaaacatcgcatattctcacttacttgtgggatccaaaaatcaaaacaattgaattcatggacgtagagagtagaaggatggttaccagagtctgggaagggtactggggtctggaggggaggtggggatggttaatgtgtacaaaaatagttagaaagaatgaataagacactatttgatttcacaacaatgcgactatagtcaataataattgtatattataaaataactaaaagagtataattggattgcttgtaactcaaaagataaatgcttcagaggatggataccctattctccatgatgtgattattacacattgcatgcatgcatcaaaacatctcatgtactacacaaatatatacacatactatgtactcacaaaaattaaaaaaataaataaaaatttgcttataacaaaggccagacagagctcatatccaagtgtacctgtgtctcaatcttcctcacagctgtcttcattttggctcaagtgaacgctttaaattatttattgtgcctcagcctcttattttaggtcaacatcaaggatggagataaaagacatctgccagatgcataccaggccagatgcatacctgggaccagatgatgttttaatttgctgatgcaatgaaccaacagctggtaaagcagctgcaattggattttaaaaccatcacctgcttaatcttttgataatcttgtcattctccaagattcctctgtgttctatacaggtcaaatagaaaagttgaatggggatgtggtgggaattaccaccacctttgcctctttcaagtccttgatggtggcactaatctctgcagtcccttcaggaatgcagtattgctttggatttactattttccttggtagaggatttctaggggcttctacctgacctttccaaccctaacagttctcacttcacaggtcagagagccaatgttgggattacgcagactgccaagtatgtcaattccaattatgcattctggaaatgggaaaacaaccacaggatggttttggagacccactagccccattgtgggatggacctgagctaaaactccattgatcacctgggctccataagctgccactttgactggtcagccacagtgatgttttgggtctcctgaaactagtgccagttcagagccagtgtatagtagtccctgaaagatctgattatttccttttccccagtgcacagttagcctggtaaaaggtcatagattcacttgaggaaggctgggagaaaaactaaaagtataaatttttggtagtgaactggggtccttcctcaaggaaacctaacctcttcattcaagggattctgggtctgtaaactggcttcagtctggaaattgattgaggaatctgagtctctgcttttatgattcatgttaagcttttgttcatttaagctagaacttttctatttatacagatcaaataagaatttagtaggcttcctacctatttcacttcaaggagcaccatgatcaattagccaacactacagttctgtgcaaatcagactattgtgattgtggctttgactctgttgtccattatggttaacaatgtgcaccttgcctttggtaatggagtactgccacttggcccctgccaccctgtgatccaattattcctattgcatttaagtttccaactcagtgattgcagttccctctgtaatgtatggcctaaagagaagagaaatcatggagctcttgaagtatgctggggttctcctcataaaaatttttcacagaattggtataaaggaaacaaaaaaaaaatttcacccccagaatatactgtgacatattatttcaagacggttattcagaaggcctgcagacaggaatacttctgaaaagctgccttttgtggaggagatttgcatctgtagagaaaaatctacattaattaaataaacagccaggctttctctgaggcccttccccttgtatagatagggaagattaattcaaccacaggttgccatctgttgtttctgaggggtgctacctgtgaggattcatttgcgtaacaaaactgactttacctcttgcccttcttattgtctcccttccataacccgtcttgccaagttccaagtccctattctttctgtaacctcaggataatataaaaccttcaaccaactgatctctgttttgagcttcatactttgtatgtgactcccatgcccatatgcatatgaataaacttgtatgccctttttacctgttgttaatctattatcagttagttttatagactcatttttgtcaaacctacaggggaaaaatttactcttccccacaggtgaaaagtatgtcttctggaccttcccagtgtgggtgaatgacaaatccactataatactccagtttccctaagactttaaatctggtcctttacattaaacaaaggcaagacaggcatttcaactttgctctgggccatattttgattcatatttcagttaaccaactagccaaactattagagtcctttctaattccatgagctgcaacattaaatgcagaatctctgctttgtgagcccatatcaataaatttaacctgatcaaactttgtggtccttccactattatcctacacccttagtatctattcctacagctgctcgccagattctgtctctatcagttagaaaacggaagtagttatttgaattgtatcacacctcctcacgggtaactcacctttggggtgtgtatctagttataggtctagaaacaaagataaacgatgaaggtggagcctaaggtgaatcagcattgtctacatgacaactgccttgagggaggccattatagtttcctcaggcaatgcagggttaatctcagattgagataggaggtccaatactactgaaggtggacaagctaatgctactgtcagtgaggatgtcattgacactgggggtgggtatgccacttctgctgaggttgggaagactgctttcactgggtgtggggagatgtcttccactggcaaatatgactcatcagaatctagtggcttgagcccaggaggtggagtttgcagtgagccaagatcgcgccactgcactccagcctggcgacagagtgagactccgtctcaaaaaaaaaaaaaaagaatcactcctttatataggatttgttttctttggtcagcaatatgaaactcttaagaatcagtattcctaggatatatttatggctggatcagtttcacaagacaccttcatatttacaaagggaagctacaagttctttttgtctttccttaacacatcaagcataaaagcaacttgaaaaagtactttatgttaggtatgagttctaaatttcttttcaaagaatcaatatgtcagtatgttcaattctttaccttctagttttaacttaacttccttataaagcaacctttttcaattacctgctccaccctgactaatttcaatcacctgttccaccctgactcattccgattcctactcctgctctgtcataaccatttttccccccaaaccactcacccgtcactctctttaaattagccaattggaattagtttagcctgtgcggtctaatcctagccaataggggaatgacacagcagcaggggccacgtgcgtcagggataagaacccttcccctcctttgtccaagtgtgtgctcaccattgctccatctgtaagggtgcacccttctatagaagtaacttcccttgctgagaattaaaagaaaattttatattcgagtgctatttcttttgtggcaccaaactttatatataacaatttgggggctcccctgtgattacgttcccctccggggacagtctctggttctctctcgtgaggaggcgcggcctgccgccttgtggtggcctcaggggtgagaaatcaagacccacccagtgcgaggaataacccaagctctcagcaacgcggggggaaaaaaaactggccagcaacctagcttaaaggatcctcacatactgcggcaatgactctgtgcacagaccaaggaaggagaagccacgggagcgggtaaagtattccgttggtggtcggaaccaaggtaagaaagtgaggggggagcggaggaggtgaagtactccttggctggggtggcttagagtttaaaaagaggcgagacatccccactggtggggattgaacctcacacgaacctccaggagtagaaaaggcaagaaatttccagtgggggaaatgagcctcaccccaaaaagtgagaaattatcagtaagggaaattgaaccttgaaccttaccccaaaaccatcaagatagactgagggagcgaatgaggcaatatgaaagcctcaatttggatgatccccttgggcaaggaaggttgaaactccaatttgtcactaaaagttggccagacatttcaaaaaagttacaaaagatagacaattgggaagaccgtcccctaagtgagcttctcagggaagctcagaaagtatacgtgagtatacatgaaaagggacgaagaaaaacagaaacaaaagacaaaacttatgttttccacctttcaacagatggctccaaacccaggtacttctagacagtttccagggagctagaaactataaagggtccgaaccctcttttaaaggatcccagcctccatctggaggaccaaggtcctcgtctaccaggccccctaaagagtatgggggagcagggttaaagaatcccagaactaaggaggaaggacaagataggtgctgtagatgtggaagaacaggccacttcaagagaggatgtcctgaactaagaaaggagaaagaagcccttccacccataactttcgaggaagaataggggggtcaggggctctgtctcttgagtcccaccaggagcccttgataaatttggaggtgggacctaaacatgagcttatcacctttttagtcgattcagaggctgctcgctcctctgtttgtttccccccgtctaatgttgtctcctcctcagaggaacttttattctccggggtaaaaggggaaggagaggggagaacagcagcataagtggctggcagaggcagggaaagaccagcagagaggagagagacagaggagggaaagagagagagaggaaaaagagagagagagaggaaaaacagagagaggaagagacaaagagggagttagagagagagagagagagagagatagaagtagtaaagagaaaacaatgtaccatattcctttaaagcccagggtaaatttaaaacctataattgataattgaaggtcttctctgtgacactctaacactccaataccaccttgttgtaagtgtaaacaagggcatagcccgaaagcactgaggccactgacaacccgtagccttcctatcaaaaatccttaacccagtaacccatggatggcccaagtgaattcaatctgtagcggcaactgctttggtagcagaagaaagtagaaaaataacttttagaagaaacctcattgtgagcacacctcgccagttcagaactagcctaaggggaaaaaaaaaaaaaagcaaaaaggtagcttactaactcaaaaatcttaaagtatggggctattctgttagaaaaagatgatttaaaattaaccaccgataattcccttaactcagcaggtttcctaacaggggatctaaatcttaattaattaccatacaaaggtccgaccagacctatgaggaactcccttcaggacaggagatagatggttcctcccgagtaattgagggaaaaagacacaataggtattcagtaattaatagggaaactcttgtaaaagcagagttaggaaaattgcctaataattggtctgctcaaacatgggagctgtttgcactcagccaagccttaaagtacttacagaaccaggaaggaaccatctataccaattgtaagttaatttggactaaacaaggtcttattaatagcaaaggataattgaaatcccaaacttataaggttttcaacaaaaagtaaagtttgctaaaagttaacagtgtaacatgtattatcctaacttctaatcttgtggtcttaggcagtctagtccacagacatgaaggaagttcgctgtggaaaagaatggttatcatctttggaaaaaaaaaggaagagaatttatgtaaaaagagtgttatatggtaaattcttgtcctaaaataaatctactggttgtttaaagaaacagatgtttgcaacaagtgagaaagttgagacatgtcaaagaattatctgtgaaagtcgtgaaaaaaaaagttataaaagggaatttatgcaagaaatgttgtataatttaaaagtaattaggcctcctgaatgtaaaactattgaagaaagtttatgtgcaagatgtataaggaaagtaaaatatacctttggtaaaaggattataaggaggcataagaatgtggatttttacctacattaaaaggttaaatatatatatatagttttaaaggtttaagcaagttttgaaacattaattgtaaaggaaattctgtgtgtaaacatactggctaaagttaaagaggtatcatccagtttttctgtgaactggacattaaaataaaagcacaacaggtttttcttaaagcactaacctgctctttaacaaaaattataaaaggttgaaaagagtctataaaaatcttaccttatggtcacatgttaaaattggataaatatgtctacaaggttttattaaaattgagtttaacattaataacacactaaaggtgaaatttagcttatctggtataaagatcatacaggaagcattgtcaaatataaaatggtgtttggctttctttggtataaaaactaataaaaattggtgctaaaggaaatttctcagtaagaaagcaccaaggactataaagtccactgttgatgtccccacatttaaaacaaaagatcaatttcttagaaattatatacttggattatcttccactttcctttccctcaaaactaaaagtcttttagcacaggtaccacccctagaatttccagtaaaccagcaccagcctgaggatcacgttctcatcaaagggtggaaagaaggaaaactccagccagcctgggaaggaccctgccttgtgctgctaactaccgagactgctgttcgtacagtggaaaggggatggactcatcacacccgagtcaacaaagtgccgccccctcctgagttgtgggccatggtcccagggaaaaaccctaccaaactaaagctaagaaaaatttaactctctttcatctattctattactctttcttctttcctcgctctattgctgaccatctagttattaacataaccaagtcaatttcacctcaaactattgcatttaatgcttgccttgttataccctgtggggacttgctaagtcaaagctctctacttcagaaaagtacctctgtccctcctgactctcctcagactgggcattagtgaattggcaccatttaatccgggggagattttgataaagaccccagtgtcaaccaggagtcttgctccctgttgtagagcttttatgccgtagttagtccaacattctgtagaccactaaagaccaagagtggactgctccaaacggtttttgtaatttcctaaaaccatacattcattttactagaaggacggccctcccccctaactgtcagctaaaccaatgtaattctatatgggttattatctcaaactctcaaagttctctcccttttctaagccagttcccttctttaagcctggaattggcttttatggtataggggctgaggtttcagggacaaaccctattagattctttaaaatgcatttctttgatcccccaacgcctgcaccttcctctaagccttcttccaaaacctctcacaacggaataattgctcctcctccatctaacgacaagaccaagatagctatcgtaaaagttaaagacttaaaacaaactttggcaattaagacaggataccagttggaatggatcaaatattccatccacacgttaaacaaaagcaattgttatgcttgtgcacacagcaggccagaggcccagattgtcccctttccactaaggtggtcctccagtcgaccaggcatgggctgcatggtagctcttttccaggattctacagcctggaatagtaagtcatgccaagctctctctgctatatcccgaagtctggcaccctgtgggtcagcccccgagggccatccagcttcagtctcccaacactaagttcacttcgtgtctctcacgacagggaggagacttagcattccttgtagacctgaagggatgcagtgagcttaagaattttcaagagcttatcaatcagtcagcccttgttcatccccgagcggatgtgtggtggtattgtggtgaacctttactggacactgctgaataactggagtggcacttgtgctttagcccagttggctatccctttcaccctggcatttcatcaaccagaggaaggaaaaataacacatcgtaaagcgagagaagccccttatgggcctttagactctcacgtctatttagacacaattggagtcccatagggaataccagatcaatttaaaacccgaaatcaaatagctgcaggatttaagtcaatattttggtaggtgacaattaataaaaatgtagattggataaactacatctactacaaccaacagcgatttattaactacattagagatgctgttaaaggaatagctgaacaattaggggcaactagccagatggctggggaaaacaggacagccttagacatgatattagcagaaagaggaggagtttgcgtcatgatgaaaactcaatgttgtaccttcatcccaaacaccaccaccactgatggaagtataacaaaggcattgcaaagtctgactactctgtccaatgagttagccaacaactcaggggtaaatgacccctttacaggatggcaagaaaagtagttcggtaaatggaaaggaataatagcctcaattcttacttccctcgcagccgtaatgggtgtacttattcttgtcaggtgctgtgtcataccatgcatccgtaggttgatgcagaggctcataaaaacggcacatactaaaacctcccttaactatcctccaccttatccagagaagcttcttttggaaaatcaagcaaaacagctaagccaagacatgttaaaaaaaggtttgaaaagaaagctgtaaggaaatacaaggggagggattgttagatatgagttctaaatttattttcaaagaatcaatatgtcagtatgttcaattctttaccttctacttttaaacttaacttcctcataaagcaacctttttcaattacctgctccaccctgattcatttcaatcacctgctccaccctgactcattctgattacctgctccaccctgactcattccgattacctactccaccctgactcattccgatgacctgctctgtcataaccatttttcctgccaaaccactcaccctgtcactgtctttaaattagccaatcagaattagtttagcctgtgcggtctaaccctagccaataggggaatgacacagcagcaggggccgtatgcatcagggataagaaccccttcccctcccttgtccaagtgtgcactcaccattgctccatgtgtaagcatgcacccttctatagaagtaacttgccttgctgagaattaaaagaaaatgttatattcgagtgctatttcttttgcggcaccaaaactttatatataacatttagtagctctatgttggcttatatgtaactctgcagttgtatttttcccatcaaaataggggaaaacataattcttgatcctttgctgactgcagtgctttgctttttagagcagtgtctcacataactgctaattgacataaaacattatctcagcaacaatcactcacacagaataaaatacacacattttttctaacaacaaaattttcatctttgaaagtgattgttttgactttataatcacaaatccataatttgaaaacaaaattaatgggagtgtggtaatttttaatataaaaaggagttctcatttggagaaatatatcaagaaatatttatgaatgaaatgatacaatgtccttgattttcttcaaaatagtatatcaggtagaaggtgagaaagtttgccatgaggtaataatttttaaagctgtgagatgagaacatgggaatttatgttttgaaattttccctaattaagaaacaattcatgcccccaaaatgtaatcaaggtagaatacagaagatcattttacacaaacatagtttaaacacataagtattgaaaaaataacatagctttagttgttttacatttattgttgaatttagtatgaggttttaaattcaataaatcttttttgtgctagtaatcaaaagaaattgagaatcaattttagtttattcttcctcatactaatagcttacataagaagtcagttttttgccaccctgaaggaaaggaccttgagcaaggcacagtgctgtgctggcttgaggtctgacccggcacactgccagtagtggtggctacatgggtgcttacatcaccacacccccagttcaaggtggctcagcacagagagggagaccccatatatttaggagaaagtaagggaaaagaccaagtgtctctgtcggtaatccagagaattcttctggatcttatccaaaaccaccaaggcagcacctctactactctacaaaaaccacagcgttattgggcttgggacacaagtcccaatcctattgctgggtatatacccaaagaaaggaaataagtatgtcgaacagatattgtactcccatgtttgctgcagcattgttcacaatagctaagatttggaagcaacctacatatccattaacagataaatgaataaagaaaatgtggtacatttacacaatgtggtactattctgccataaaaaaagaataagattctgtcatttgcaacaacatagatggaactggagctcattatgttaagcaaagtaagtcgagcacataaagacaaacttttcatattcttattattttgtggcatctagaaatcaaaacagttgaactcatggacatagagaatagaaagatggttaccataggctggaaatggtagtggaggccaggggtgggaggtaggaatggttaatgagtacataaaaatagaaagaatgattaaagcctagtatttgatagcacaacagggtgactatagtcaataataatttaaatttacatttaaaaataactgagagtataattggattgtttctaacacaaataataaatgcttgaggaaatagatacccaattttccatgatgtttttatgcattgcatgtctgtaccaaaatatcctatgtaccccatatacacctactatatacccatgaaaattaaaaataagaagtaaaatgagcttctctcacttatactatattttaagtagattacagaagcttccctggtaactttttccagtatttaaataacaccattgttggatgacataagcttaagaaaatattcatcactcctggtgagacaatacataaatacaaaaatacataaatattttattgcacagaaaaagggcaaacatagagatttgaagaaaatctaggagaatgtgtacacttgatttatgtgaagaaaacttggttattctattcttagaaatgttaactggcaatgcaaaaatgattaaaatttaatttccaaggttaactttattcataacactgcttttggcaatgaagatctcatgagaactccctcacggtcatgagaacagcactggagaaactgcccccatgagccaatcactcccaccaggtccctccctcagcatgtgaggattacagtttgagatgagaaatttgggtggggacacagagccaaaccatatcactgggcccctggcccctccaaatctcatgtgcttttcacattccaaaaccaatcatgccttcctaacggtccaccaaagtcttaactctttccagcatttattcaaaagtccaagcctgaagtctcatctgagacaaggcaagtccctttcacctatgagcctgtaaaatcaaaaggaagctagttactttcaagatacaatggaggtacaggcattgggtaaattttcccatccaagtggaaaaaaattggccaaaacaaagaagccggaggccccatgcaagtctaaaacctgcccaggtagtcaataaatattaaagctccaaattctcctttgacaccatgtctcacatccagagcatgctgatgcaaggagtgggcttccatggccttggacagctccaccactatcgctctgcagggcacagctccgcagctgtttacataggctggcgttgagtgcctgcagcttttctaggtgcacagtacaagctggtgatggatctacccttatgaggtctggacaatggtggccctcttctcacagctccactaggcagtgccccagtggggactctgtgcacaggctccaaacacacatttcccctctgtattgcctcagtagagttcctcacgagggattcacccctgcagcagacttctgcctggacatgcagtcatttccatatatcctgggaagtttaggcagaggctcccaaagctcaactcttgtcttctgtgctcctgcaggcccaacaccatgtggaagccaccaaggcttggggcttgcaccatctgaagcaactgcctgagctgtaccttgaccccttttagccgcagctggagctggatcagctggaatgaggggcaccatgccctgaggctccacagagtagcatggccctaggcccagctcatgaaaccatttttctctcttaggcctctgggcctgtgaagggaggggctgttgtgaagatctctgacatgcactggagacattttccccattgtcttggctattaacatgtggctccttgctatgtttgcaaatttctgcagccagcttgaatttctcctcagaaaatgggtttttctattctatctcagcctggacttcattatccatatcactgtcagcattttgatcaaggccattcaacaagtctctaggtggttccaaactttccgacatcttcttgtcttcttctaagcagaatcctaaagtgtgggttagcagatcagaggagtgataaaaagcctaaactcctcatcccatccacgaagagaggcttggcagcctcctgaggaaaagctttgttctatctcatactatagcctcacatttttaaaaacaatttacttaaactcatttcccagtagaaattgaacaaggagtatttgttctgtgcagttgcataggagaaacttgaccctgccagaggaaagggctgtcccaggaacacttggcaagagagggtggtggtttgtgctgctacggaatcacagcagctattttctgcttctctctacatacctttgtgctcactaaagcagagagaggccatgagatattatacgacccagcgacctcattacactgcatttcattgaaaacctgactgtggtcccacagttctagttgagcatcagccctgacattgaattctgtttctgtatcatcttgggcaagggctttatatttaggatcacagattcctcatgggtacaataaccattcctacctcacaaaattgtgaggattcccaagaatgttgaaaatcatctagtctggtaaggactcattaaatcatctacttctctggtgacagagctgagactggcttcctggtcgccttctttttttttttttttttgtgagacttgttgcccaggccggagtgcaatggtccaatctcggctcactgtaactcccgcctcccaggttcaagtgattctcctgcctcaacctcccgagtagctggaattacaggtgcatgccaccatacccggctacttttttgtgtttttagtagagatggagtttcaccatgttggccaggctggtctcaaactcctgacctcaggtgatctacccacctcggcctcccaaagtgctgggattacagtgtgagccaacctgcccagcccctggccatctttattaaccagtgctcactgtggccatgttccttaaccctgggcctcacacagagcattgaggcagcatgctgcccaaaggcatttcacatttgtagttgggagttgacgctacttccattctcacagttacttccaacaatctgttcctttgctttcctagcccacttttgttgcttcttcctcactatactcctttccaaaggagaagaatgtgctaggtgccggcatggtgtagtgtgggaaacaaagacagacgtgggaacctcctaactctgcagacctcatggctcagtagcaaaaactgaatggtactatctgtggtaccacctggttagcctcccaccaccagtcctggaactagcattccccttttctggggaactgctccacacaaacacagattccaggtatgtgattccaggagagctttatgttgctacatgtcccaccttcctcaccacagctgactggctctggggtcagatagtcgtgatctctgcccctgtgctttgtgttcctggcttaaggttaggtacccaaggaccagcctgattttattccaggacatcgaggcagaaggaaagcatctttccttgatcttcaagagtccatgagggatttttcttttttcttttccttttggagaccgagtctttcactcctgtcgcccaggctggaatgcagtggtgggatcatggctcactgcagcctcgacttcctgggtttaggcaattctcccacctcagtttcctgagtagctgggactacaggtgtgtgccaccatgccttttttttaaaaatatttttttgtagaggggtgtttcgccatgttgcccaggctggacttgaactcctgggttccagcaatctgcctgccttggcctcccaaagtgctgagattacagtggtaagctgccatacctggccaatgagggattttaaatttcactctccagaaggaaaaaaaggagaaggattgagatatgtgtgtgtgtgtgtgtgtgtgtgtgtgtgtgtgtgtgtgtgtgtgtgtgtgtatgtgtgtgtatttggtgcagtaagcaaaaggaagaaagtgtgataacccagagctatctaaacctctcctttttctcatctgccttcccactgagagggtgtgttctggtatgcactccagtgccataagcctacaggaccctgtgggtacagcctgtggttatccagtaccttctttgactagctaatttgattagttagaagaggctatctcctgtaacaaatgtttctaatctctttagcttttaaagtaaatttttattttttgtttttatcaaggtccagtgcaagttggtggtgacaatgatgaggggacattctccataagttttccaaagttccaggctccttctccaaattggatatgtcatattgtagggtctgttcctcttcttcacttgagacatggattgcacagggtgtgtcctataaactaggccttatttggccatacatcagttattttcatattccaatagccagaaatcagtacatgtccccatcaaatcacaagagtagcttgaaaaatatggttacttgtggaccaagatgaaaacaaataagctttggtgaagttattctgccacagcgagtttctctaattggaagatttgaaaagtactatcaagttcattttgctacagacctaagtttgttcttcagtgagctgagtcttgtgtctactaattggtttcaaattcagcagggaagacacggggattagttattgagtacctaaaactgtgaacatacaggacttttcgaagtaaattttaaaaaaggagtctttactctggtgtttaagctttgatcctgaaaacatatctgaaatcacattccctatcatgtggagtcatccctcctgcagacagaattaagcttcagggtgcagcagacatgggtgagcatttaaagggaagttgacatctacctagaagacagatccactaaagttttccagtgccagagaaatgccatgctttgggcatttagaatagttcctactctgcctgggagctctatacctttatctccaaaggagatgagcactccctaattgacaccctccaccctcctgttcatgggagaatcctactggtcatccagactcacaactgtgcattaggtccatgctcatcaccgaggctaacccagtccttgattccaatcatgaatggacaaacgttttccagatatttaaggaaagtgaggaagatgcacaaatagaactaattctggaggagggaaaaaaggatataatacaggaaacagaagaaaacgttatcagaacatactctcagagtttaagaaagacaagaagtttatgaaatgagaacaagctgtcatagaggggaacaatcaggggacaggcgaaagtccttggacactagaaaagttactacagaattgacgtagcacagaggtctgatagtgcccaattccccgggctgcccatagaactcagcgtgctcccccacccccacctgtcagaagtccctcgcagctccgcaccagcccacacccgcccgaccttgtgcgctcctccccgcataaaggtctccaccgctcacttccggtcccttcgcagagcctgtgaccacactaccaccgggcccgggggacgacgccctccaccagccgccgctgtcgtccaccatggtggtgctccgaggaccccgccgctgccgccactgcccacgccgatgccactacccgctccgggcccctggcaaacccactgcttttcccctcctcccagcgcccgcgctgcccgccctgggcccgctgtcgccggtgcgacggtaccaccatcccagctgtgaggctgccatcaacacccacatcagcctggagctccacgcatcctatgtgtacctgtccatggccttctacttcgaccaggacgacgcggccctggagcactttgaccgctacttcctgcgccagtcgcaggagaaaagggagcacgcccaggagctgatgagcctgcagaacctgcgcggtggccgcatctgccttcatgacatcaggaagccagagggccaaggctgggagagcgggctcaaggccatggagtgcaccttccacctggagaagaacatcaaccagagcctcctggagctgcaccagctggccagggagaacggcgacccccagctctgcgacttcctggagaacgacttcctgaaccagcaggccaagaccatcaaagagctgggtggctacctgagcaacctgcacaagatgggggccccggaagcaggcctggcagagtacctctttaacaagctcaccctgggccgcagccagaaacacaccagagcccagacaggccccacagccacggggtgccttcccctgctcgcgccaccaggcgggacgtccatgttcccttttcagaacattctcttcatttttctcctctcagttttaccgttgttggcaataaagttatctgttctcaaagcaataaaggtgtccagctgatgcgtatctgcagcactctcaccttttaggaatcagggcacatccccatgcaggtttaaagtaggtattcagcagtctttccattcagccctgccccatctgcatgcagctcaggatctgcgggggtggaagggaaaggtattttatgggcccctggaaaatacattagtcttccccttataaactttgagggcatgtgggatggggtggggtgaggtggggtagggtggggtgagatgtgtggggtgggtggggtcgggtggggcgtgctgtcttgggccatggtatctgtgggtgtgtatgcatggtatggtataaaacatggtatggaattcatcctagcggttgcctctggagaagaagggaagggaatgagattgggcggggataaaaataatagtctttaacttgacatgaaaagttatctttttaaaacatgcaattgctaagtattcttgcttctgggcagcaagatgggggctctgggggacagtatggcagagtacctctttggcaagctcaccctgagtgacacggataatgggactgagccttaggctgccttccccacagatatggggtgacttcctgcatcttgcccttcaactgtaccatttcttccattaaactggttaaaaaaacagctcaaaagaaggactgaaaaacataaggtcaaagctgaaggtcaaatttgtgatattgaatataaagtagaataaatataaagtagaataaatgcccccaaatgtcaaggcagtgactgtctgctctgaagaatgtagaggggtggcagagagttgaaggtgcagaccaggcagagccagtatagccgatccaggtaggagactagtgcagcttgagctgtgatggtggctgaggaaatgaagagaggtcgaccagttccagatggactttcgacaaagggagacaaactttactcatggacaggaggtgaggagtgggagagggggaatataatgtaagttctgaagtttggacctgagcacctgggttgatgatggtgttattatctcccgtggggatggttgcatgggtcccccggggtggaggagcggggaatgcatgccatgtaaagtcagattttcattagacatccaagtggaaatgtgaatcaaggagctgcaaaaatgtcacgtttcgaagtagacatatgggggacattttatagacggtattgaagtcatgtgattggatgacctcaccagaaagagactataagggagagtatgagaaatctagtccaaagtgcggggcagctaacatttagaggatggttgatgtgtttgaacacccagagagttgctggtcccaccttgacctttatctgccccaagcttattagcttattcccaatgtctgcccccaagcttatctcaaaatcatcctcttcctgtgaagctcaatgtggcctctggtttctcctttcaagatatagagaaaagttcgccttttaccttttctttatggctatggatagaaaggtattatttcctagtcagaagaagattccatatggaaatgatacacctgtttgtctaagatttttttcttgttccccattaaaaactcttctcctctctcagtctactctctatttgaccaaaggaaacctccatccatgtaaaccataacattgtccatgtctgttgaaaaatacttaaaaacatctattttctgtgccacaaaagaaagttacaaagaaacaagaaacaaaaaaatcttgtttcttttgtgggctacaaaggtaaaagtcaaaaatttacagaatatatactttagtcagagacacttgggtagcttgcatcattttaaagctagtggattgttttgggcattgtattagtccgtttttcatgctgctgataaagacatacctaagactgggcaatttacaaaagcaagaggtttaatggacttacagttccacgtggctggggaagcctcacaatcctggtggaaggtgaaaagtatgtctcacatggcagcagacaagacaagagaatgagagcctagcaaaacgggtttccccttatcaaactatcagatcttgtgaaacttactcactactggtaggacagtatgggggaaaccgccccaatgattcaattatctcccactgggtccctcccacaaaacgtgggaattatgacagtacaattcaagaggagatttgggtggggacacagtcaaaccatataagcatttattaagatacaaacaagtttagcagtgcaataattatcttacacatttccatatgagtgcactgtaacacttttcttaaaaattaggattctggcactttgagttcagtttacagaaaatgctattgtccctttactcatcttagtcaaatttggtcttctcgctgtaggtctttctctgcctgctgtaaggacttctgaattctctgactttgtctcagctattacctactgaaatatatatgtcctttgactgttctcctgtggatatgagaaagaagagagcaagcattaatttttgagtgtttcaaactttaagttgactgaggggacttcttaattttctgttttggagagaaaatatggtgtagtgttttcttaacctcagattgcctgggttcaaatcccatcttggccactcattttaggtaaacttgggtaagttgtttaacttttctgtgcctcagtttctccatatgtaatatagggataataaaagcattaaccccattgggttgttgagattaaataagttaatacatgtaaatcacttagagcaatgcctggcacagtgtatgttcactatgtggtactcatggtttatcaccattatcatcctctactcttttaacttttatttaggttcaagagaacaagtgcaggtttttatataggtaaactgctgtcatggggggttgttgaatagattatttcatcatccaggtactaaaccgtgtacccaatagttatttttttgttcctctccctcttcccaccctccacactcaggtaggccccagtgtctgttgttcccttctttgagtccacgtgttctcatcatttagctcccaattataagtgagaacatgtggtatttgattttctgtccctgcattagtttgataaagacaatgggttggaagccatcatcctctacccttatgtttctttgtggtctttatgctttgggaaaatacttcacttctacacgttgccactgggggtctctcttgcatgtctagtaaccaagttgccctgcatactgagaaggaaaaaaccttagaagctgtttggttgtcaggtgtctccaggactcaggagggtacatggctgttttccctaccccccacacctcagtcccaagacaggaggaaggttgtgctgtgacaactttctgtgctatactccacaccccccacacccctattctatctcaaccagctttcccttgaatttactcctagaacactgtgcttgtgatccaaatttagagactagggtttttaaatgataatttggtgggtgggggctagcgaaggggtcatcctcattaattgggtcaaggattaagtcatgggggttgaggctgtcctcttgtgctaagtcagttcctgggtcagatcacaagaccagttaaaccagcttaccagtccaggtggaaccagctggtccaacagaatgaagggtcttgcacaccagtcttaagttttacaatagtgatgctatctatagaagcagttagggaggttatgagccttgtgacctctgactacatgactcctgagccataatttctaatcttgtggctaatttgttagttctacaaaggctgtttgggtcctcaaagaaataagggttgttttgggaggttggaaagcatggattttgcatgcatgaagggcatgaatttgggggccccaggggcagaatgctatcaactgaatgttcatgtaccctccaaatcatatgttgaagcactatcttccaaggtgatagtatttgaagatggggctgtaaggagaaaatcctggaatcatatagaaataccttcccccaaactgggagtgagctaagagatcaagaaatgacttggagaagtccagcttggcgagtagatgagattattaggattcacataggaggcactccgggacaacagcaggacagctgtagagatctgcaccgcttattatttttaaagtacttttcagctaattttctggctccttgcttactgtgtttaagcgatgagactttttcttgataggttctcagatactgtctggaatgtttgagttctcagggacacctgctctctggctgggcaacatggccttggctcatggcctggccttcagggtttgggcagcagaaataaaccttttagtaagctgattgggacccttcacactacaggggccttcaagatataattaggtttagatgaggtgaggtcatgaggaaggagcctttgtctgatagtccttacaagaaaagacaccagagagcatgctctttctctccctctctctctgccatgccatttgagcacacagtaagaagttggtcatctgcaaatcagacagctgtcaccagaaaccatgtgattaccctgttctcatacttccagcctccagagctgtgagaaataagtttctattaagcaatacactctatggtattttgttgtggcagcctgagcagacacttggggagctggaaaataatactgatgttgctgtttaaacgcactaagtcataccctcatgcaagtattggatcaaacataacataactttattgtaatttcaacattattgtatttgaaaatatttaaagtgaattggaatcctctcagttccattgattttgcatacagacacacacacacacacacacacacacacacacacacacagacacagacacaattttgtccattttgttttatcacaaactggtctgtcttataccatggattgttaaactatagcctataagccaaattcagccaaccatgtctttataataaagttttattgaaacggagccatgcccatttattgatatattgcccattgctgggtattaactgcaaagtcagagttagtagatgagacagagactatatgacatgcaaagactaaaatatttagtatctgtaggaacagaccctaaatttacctaaaaatattcaccggagatttttaacatttcaatggtctttcactgtccaaaatgcttattgtagctttctcatacattttctaccaccactactctttggcagaaagcaattgcctgaattatctaatctaatatgctcatgatttaatcaattatctcagaaaagagattatgacagacactatccattactgatacaaaagccattctatactttcttccttagtaagagaacattgaagttttaagagtcatggtgttgacagtgtcttgggataaataataactagtcaaaatgaatcgtgaaaattgtttttctctttcaagatatttgctttcctactatttcctgctgctagagtttgccagatgaatgagttctcaccaaatacataaatggaaataacatggatttctaataaaattttacttgcctgataaatgacagcactttgtgaaaataataatttcacctcatccttgtcatgctgattgaatgctggtatggagatgtgatctttgtgcagaaacagccacttggtatccatgaggacaaggccaagggagttgcagaacccagtgtagagccctgtcataattgagtcagaagtataaactctgacatttaatatgccccagggttcctgataaataacagcagttagccttgctacttaagctactttgtagatattctatttgttatgattcatctgatataaaaagactgtaaggagaaggcatttttctgctcaaagggtacacacatgttgtaagttgaaaaagttctgaagaaccaatgtacagcatgatgactatagttaataataatgtattctatcctagagttaggagagtatatattaagtgttctcaccactaaaaagcaactatgtgaggtaatggatatgctaattgggttgattttggtaatcatttacaaggtatacacatatcaacacatcacattatataccttgaatatatatatatatatgtatatatatatatatattttgtcatgtatactgcaataaagtttcacaaaagaaaaaattaaatgcatctttctccttgcttttacatagcaagtatttgtcaagcgcatgttacgttaggtaccatttcaggtgctttccagacattgcctgtgtccttctcacaacaaccctgtgagacatggatctcccctattttacatcgagaaaatggtttcagagtagtgtcactatctgaaaccttatagttagtaggtgatagagtcagaatcacctggcttcagaaagaggtaatgtctttgcatcatttctgttctgctgtcatctcaattccttgttccacatgccataggagactttatttaagcaacagacctgtggaattggtctcttcgtatctttttaataaataaatggcaggtttgtgcgttttgtgtgtgtgtgtgtgtctgtgtgtgtgtacatgacccttccaggtgttcagactcagagtccgtgttctctctgttgcatccagcccttaatgatcaatttcactctccatgttcactaaacacacaattccataaaccttgtctgcatctctaactggctgctatctcatgctgtaattcatagccagtattctagaaaaggttacctgttcttgttgacttcccaggagtaatgaatttctttaagtgttgggagaagtaatatatccacaatgttcagaaataaaacatataaaagggtatattatgaaggcttctccctgtccctgttttttgagggggaggtttctgtatatccttatatacatttattttacggagttatcagcatacatggatatataccctcccccctcacccagacagttgcttaattcacagcaccccgcaccttgtaccactgggcacacctagctttttggtttggtgagttaaataacacccagctgtgatgggcgcttcaggttaccctcaagcaggaagtgaaagctatggctgtgctgtatactgccaagctgaaaatggaaagttctttcttttgtttgtttgtttgtttttgtttacttttgtgttttttatttgtttgtttttgcaggcggggcaggtggtgacagagtttcactcttatcacccaggctggagtgcagtggcaggatccccgctcactgcaacctctgcatcaactgattctcttgcctctgcctcccgagtagctggaattactggcgaccaccaccacatctggctaattttctttgtatttttagtagagatggggttttgccatgttggccaggctggtctacaactcctgaccttgtgatccgcccacgttggcctcccaaaggaaagtgtgttctaatatgcacaaagagcccatctgtgaaaactaggggattgtttcttgttttgttttgttttgttgaggaggggtggttctagataagaactctttcaattcacaagctgaccactacaataacaggaatgagatgtcggtggccacacatgacaaagaatacagatgttacaaaatgagttcaacaaagtcactaaaccagcaaacaacaactggaacaaataacaaaaacaagcgttggagtctcagtctgttcatgctgctatatcaaacttccacagagcggataatttatgaaaaccagaaatgtatttcctatatttgtagaggctgggaaggccaagatcaagactccagaattaggcatctagcaagggtcttcttgctgtgtcctctcatggcagaaggagcaaaaaatgataaaagggatgaactctatgtcgtcacatagcagaaagatggaagagtcaaaggattagtttcctccagtgctttttaaaggtcactagtaccagtgatgacgaatctaccctcacgacttagtaacatcctaaaggcctcatctcttaatactactacattggccattaagtttcaacagatacattttggagggcatttagataatagcagatgggctgagggaaaagatgatttctagaattgccacttaataatgttaaacatgtccagttttcaacaaaagaatataaatcatatcaggaaacaaaaagtattgcccatacatgagaaagaagaaatcaacagaaactgtctcagaggaaatccggtcagtggatttactaagcaaatattttaaatcaactctttgaaatattaaagaacatcatttagaaagaagaaaagaaaaccaggagaatgatgtctcatcaaatacataataccaataagaaaatagaaatgatataaaaggaacaaaatagaaattctggaatggaaaaggataacaattggaatgaaaatttcagtagagggagtcaatagcaaatttgaataagaagtagagagaatcatcaatctccaagaaaggtcagttgagattatctagtctgagaatctggaagaaaaaaaaagaatgaagtaaaattaacgaagctcagagtacttgtggaaaccatccagtgtaccaaaacatacataaagggagttctggaaagagataaaaaggggaatatgaagggatataaagaatatttgaggaaagaacagtcaatatcttatcaaatatgatgaaatatgttgatttacacatccaatagattccatgtagggaaaaatcagagatatccccaccaagacactataaacaaaaggtaaaaaagacaagacaatgaaaacatcctgaaagcggcaaaatagaagttatacttcacatacacaggatgatcaataatattaacagctgatttctcaacagaaagtatggaggctgtattagtctgttttcattgctataaagggatatcagaggctgggtaatttatttaaaaagatgtttaattggctgatggttctgcagactggacaaggatggtactggcatctgtttggcttccagagaggcctcagggacctttagctcatggcagaagacaaactggaagtaggcaggtcatatggccagaaaaggtgcaagagaggtttgggggaggcatcacactttacaacaatgagatctcatgagaactcactcactattgcaaggacagcagcaagccatgagggatccacccccatgaccaaaacaccccccaccaggtcccacattgtacctctgggaattataattcaacatgagatttggtggggacatatatttaagctatatcattctgcccctggcccctcaaattttattttcttcttacattgcaaaatacaatcataacttcccaacaggctcccaaagtcttaactccttccagctgatatcaactcaattaaaagtcccaaatgaaagtccaaaatcttatttgagactcatctccttcctcctatgagcttgcaaaatcaaaacaagttatttacttccaagatataatgatggtataagcattgtgtaagcactcccattccaaaatggagaaatcggccaaaggaaagggcctacaggccccatgcaagttcaaaacccagcagggaactcattaaatcttagagcttcaaaatagtctccttacactatatattgtgcatccagggcacagtggtgcaggggatgggctcctatggcctttggcagctccacacctgtggctttgcaggattcaggacccatggttgctttcacagcttgttatgtgcctgtggcttttccaggcacaaggttcaagctgcctgtggctctaccattctggggtctggaagatggtgtgccctttccatagatcaactaggtggtgccccagtgggaactctgtgcatgggctcctatgtcacatctcccctccgcactgccgtgccactgcagcagacttctgcctggacactcaggcttttccattcatcctctgaaatctaagtggaggctgccaagcgtccttcagtcttgcactctgcacacctgcatgcttaatgccacgtggaagtcaccaaggctttgacttgcaccctctgaagtagcatctggggctgtgtctggggtcatctgagctgaggctggagctggagcagcctggatgcagggagcagtgtcctgaggctgcacaggttactggggcacaggttagtgagattttgcagggacatatattcaaactataccagaggcctagaggtaggaagatgacatattcaatgtgctgaaagaaaaatactgctgatgaagaattctacattccacaatgtatccttcaaagaaatcaaaaaataagtcatcccaagataaacaaatttcaacagtgattctcactagtacacttgctctgcaggaaatgctaaagggactttactgctgaaaaataaactgacaaattaggaatttcatagggttcaaacttaatatatccataaacttcatgtagaaaaaaaagtatcaaatacttaagtataatgactaaatagtgttgccaatcatgatatttctagaaagtatgccataggatacccatttcatgaaaaataaagagctgaactttttatggtacatttttcacaaatccataaccattaggaagcactcctttatacaggacttgtactcttggaacagcaataggaatctccgaagaaccagtactcctgggatcaatttatggctagattagtttcgcaagtcaccttcttcatatttacaaaggcaatcttcaagttctttttgtttttccttaacaaatcaaacataaaagcaacttgaaaaagtactttagtagttccatgttgtcttgtatgtaactctgccattttatttttctaatcaaaatggaagaaagcataacttgtgctcttctgctgaatgcagtgctttgctctttaaagctgtgtctcacataactgctagttgacataaagcattctctcaacaaaaaccatttactcagaataaaatacagacactctttctttcttttcctcttcttcttgtgtgtgtttttttttttgaggggacattgtccatatgttattcaaagttccaggctccttctccaaagtggatatgtcatattgtagggtctgttcctcttcttgagacatggattgcacacggtgtgtcctataaactaggccttatttggccatacaccagttattttcatattccaatagccagaaatcagtacaagaccccatcaaatcacaagggtagctaaaaaaatatggttacttgtggaccaagatgaaaacaaataagctttgatgaagtcactctgccacagcgagtttctctaattggaagatttgaaaagtactagcaagttcattttgctacagacgtaagcttgctcttcagtgagctgagtcccatgtctactaattggtttcaaattcagcagggaagacacggggattagttattgagtccccaaaaccgtgaacatagaggacttttccaggtaaattttaaaaacagagtctttactctggtgtttaagctttgatcctgaaaacatatctgaaatcacattccttgtcatgtggagacatctctcctgcagaaagaattaagcttccgggtgcagcagacatgggtgagcatttaaagggaagctgacatctacctagaagacagatccactaacatattccagtgccagagaaatgccatgctttgggcatttagaatagttcctactctgcctgggagctctatacctttatctccaaaggagatgagcactccctaattgacacactccaccctcctgttcatgggagaatcctattggtcacccagactcacagctgtgcattcgatccatgctcatcaccgaggctaacccagtccttgattccaatcatgaatggacaaacgttttccagatatttaaggaaagtgaggaagatgcacaaatagaactaattctggaggagggaaaaagaggatataatacaggaaacagaaaaaaacgttaccagaacatactctcagagtttaagaaagacaagaggtttataaaatgagaacaagctgtcatagaggggaataatcagggggcagacgaaaaagtccttggacactagaaaagttactgcagaattgacatcacgcagtggactgacagtgcctagttccctgggctgcccacggaactcagtgtgccccccctcgccaccaccaccatccacccgacggcgcgcgcccctccacccatacgggtccccacagcccacttccggtcccttcgcagaccctgtggcaaccaccaccgcctggtcccgaggaccctgccctccactggtcgcctccgtcgtccaccatgttgtgctcagaggcacccgccgcggccgccactgccgatgccgatgccgccgcccgcttcgggaccctagcgaccacaccgctttaccctgcctgctcctcgcgcccgcactgcccgccctgggcccgctgtcgcaggtgcaccagaacaaccatctcagctgcgaggtcgccatcaacatcaaggtcaccctggagctccacgcctcctatgtgtacctgtccatggccttcttcttcgaccgggacgacgtggccctggagagcttcagccgctatttcttgcaccagtggcacgagaagagggagcacgcccaggagctgatgagcctgcagaacctgcgcggtggccgcatctaccttcgcgacatcaggaagccagagtgccaaggctgggagagcgggctccaggccatggactgcgccttctacctggagaagaacgtcaaccagagcctcctggagctgcaccagctggccaaggagaacgacgaccccacctctgtgacttcctggagaaccacttcctgaaccagcaggccaagaccatcaaagagattggtggctacctgagcaacctgtgcaagatgggggccccggaagcaggcctggcagagtacctctttaacaagctcaccctgggccgcagccagaaacacaccagagcccagacaggtcccgcagccacggggtgccttcccctgctcgcgccaccacgcggggcgtccatgttgtcctttcagaacattctcttcagttttctcctctcagttttactgttgttggcaataaagttatctgttctcaaagcaataaaggtgtccagctgatgcatatctgcaacactctcaccttttaggaatcagggcacatccccatgcaggtttaaagtaggtatccagcagtctttccattcagccctgccccatctgcatgcagctcaggatctgcgggggtggaggggaaaggtattttatgggccgctggaaaatacattagtcttccccttataaactttgagggcatgtgggattggatggggtgaggtggggtggggtagggtggggtgaggtgtggggtgggtgaggtcgggtggggtgtgcagtcttgggccatggtatctgtgggtgcgtaaacatggtaaggtgtaaagcatggtatggaattcatcctagtggttgccgggtgctgtggctcacgcctgtaatcccagcacatgggaggctgaggcgggtggatcatctgaggtcgggagtttgagaccagcctgaccaacatggagaaactccgtctctactaaaaatacaaaattagccgggcatggtggtgcatgcctgtaatcccagctactcgggaggctgaggcaggaaaatcgcgtgaatctgggacgcggaggttgtggtgaggggagatcccgccattgcactccagcctggacaacaagagcgaaactccatctgaaaaaacaaacaaacaaacaaaaaacaaaatatgcaagtgctaaggattcttgcttctgggcttcaagatgggggctctcgcggacagtatcgcatagtacctctttggcaagctcaccctgagtgacacggataatgggactgagccttaggctgccttccccacagatagggggtgatttcctgtatattacccttacgaattctccattcatggtttttccttcaattgtaccatttcttccattaaagctggtttaaaaaaaaaaaacagctcaaaaggactgaaaaacataaggtcaaaactgaaggtcaaatttgtgatattgaatataaagtagaataaatgcccccaaaatgtcaaggcagtgactgctttgaagaatgtagaggggtggcagagagttgaaggtgcagaccaggtagagccagtatagctgttccagttaggagactagtgcagcttcagctgtgatggtggctgaggaaatgaagagaggtcgaccagttccatatgggtttttgacaaggagacacaaactttgctcatggacaggaggtgaggaatgggagagggggaatacaatgtaagttctgaagtttggacttgaacacctggattgatgatggtgttattatccccctggggatggttgcatgtgtccccggggtggaggagcggggaatgtatgccatgtaaaatcagatttttattagacgtccaagtggaaatgtgaatcaaggagctgcaaaaatgtcacatttggaagtagacatacgggggactttttatagatggtattgaagtcatgtgattggatgagctcaccagaaggagactataagggagagtatgagaaatctagtccaaagtgcagggcagctaacatttagaagatggttgaggtgtttgaacacccagagagttgctggtcccaccttgacctttatctgccccaagtttattaccttattcccaatgtctgccccaagcttacctcaaaatcatcctgttcctgagaagctcagtgtggcctctggattctcctttcaagatatagagaaaagttcaccttttacattttcttcatggctctggatagaaagatattatttcctagtataaagaatatttcatatggaaatgatacacttgtttctctatgttttcttttttcttgttcccctttaaaaactcttctcctctctcagtccactctctatttgaccgaaggaaacctccatccatgtaaactctaacgttgcccatgtctgaggaaaaatacttcaaacatctatcttctgtgccacaaaagaaagttacaaagaaataagaaacaaaaaagtcttctttcttctgtgggttacaaaggtaaaagtcaaaaatttacagactctatgctttagtcaaagacacatgggtagcttgcatcatttcaaagctagcaaattgttttgagcattgtattagtccatttttcaggctgctgataaagacataccaaagattggacagtttataaaagcaagaggtttattgaacttacagttccacatggctggggaaccctcacaatcatcgtggaaggtgaaagtcatgtctcacatggcggcagacaagagaagagaaggagagccaaggggtttccccttatcaaactatcagatcttgtgagactcattcaccaccagtaggacagtatgggagaaactgcccccatgattcaattatctcccaatgggtcccttccacaaaacatgggaattatgggagtacaattcaagatgagatttgggtggggacacagtcaaaccatataagcatttattaagatacgaacaagtttcgctgtgcaacaattgtcttccacatttccgtatgagtgcactgtaacacttttcttaaaaattaggattctggcactttgagttcagtttacagaaaatgctttcgcctttttacacatctttgtcaaacttggtcttctcactgcatctctttcgctgcctactgtaaggacttctgaattctctgactttgtctcagctattacctattgaaatatatatgtcccttgaccgttctcctgtggatatgagaaagaacgagcaagcattaagttttgagtgtttcaaactttaagttgactgaggggacttcttaattttttgttttggagagaaaatttggtgtagtgttttcttaacctcagattgcctgggttcaaatccaatcttagcctctcattttgggtaaacttgagtaatttgttcaacttttctgtgcctcagtttctccatatgtaatatagggataataaaagcattaaccccattgggttgttgagattaaatgagttaatatatgtaaatcacttagagtaatgcctggcacagtgtatgtttacaatgtggtactcatgatttatcaccattatcatcctctactcttttaacttttatttaggttcaagagaacaagtgcaggtttttatataggtaaactgctgtcatggggggttgttgaatagattatttcatcatccaggtactaaaccgtgtacccaatagttatttttttgttcctctccctcttcccaccctccacactcaggtaggccccagtgtctgttgtttccttctttgagtccacgtgttctcatcatttagctcccaattataagtgagaacatgtggtatttgattttctgtccttgcattagtttgataaaaacaatgggctggaagccatcatcctctacccttatgtttctttgtggtctttatgctttgggaaaatacttcacttctacacgttgccactgggggtctctcttgcatgtctagtaaccagttgccctgcatactgagaaggaaaaaaccttagaagatagtttggttgtcaggtgtctccaggactcagaagggtacatggctgttttccttaccccccacacctcagtcccaagacaggaggaaggttgtcctgtgacaactttccgtgctattccccgcccccgcccattctatctcaaccagctttcccttgaattcactcctagaacactgttcttgttcttcccaaacccaggttgcctgagtctcctgtttccatcctgaacttcctcccactcttcagagatggacaagagcaacaggatgaagtgctcaccctgatccccacctttgtctggatgtttggagctgaaaaggagaggaatggctaggtgggcactggggggagaatgagaaaaagagaacacattagggccactgacaacataagtaaaatccacatatcatcatgagctttggcatagaggctctcaagctttgctgcacatccaaatcacctgcagagcttttgaaaatctcaatgtccaggcagcatcccagaccaaatacataagcctctggcgcagggcctgggcatgccaggcattgaaaaccagcactagcatctggctgctcaaaatatggtctgtggaccagcagtatcaatctaaactgagaacttgctagcaatgcaaaatttcaagccacaccccagggctacggaatgagcatctacattttaacaagactctcggtgatcaatttgcacactggaatttgagaagcactctttagcaccctgattgccaaatatggctgcaccttgaaatcacctagataacctgaaaataatactaatgcctggacttaatcaatgtgctcagctatggagagtgagaaaaaataaaaggaaaaatagaaagacaaatagatgctaaagaaaggtgaaaagtttagaatatttggtagctttaggtgaattcagggttgcggcaagttaccataaacatggattggcaaagactttctataaagaatgagatagtaaatgttttaggctttgcagctactgcaaaagacctctgtctcaactacaaactctcctgctggagtgaaaaagtaacgacaaacagtaggtaattgaatggggtggctaggatgtttggggctgaaaacattgaacaatgcctgactagcctttttgacagattcttcataatcacatattcatcacggaggctgtttaaatcaatgtgctcagctataccctcatgtcagtactagaccaaatacgataaaaacttactgtaacatcaacaattactgactcaacaataattgatctctgtctcacacacacactagcttttatctattttgttgtttatcacaaactggtttgttgtatagcatgggctggcaaactacagccagcaatcctaatctggcccccacttttttggtaaatatagttttattagaacacagccaccgcattcaattacctactgcttgtggctactttttcactccagcaggagagtttgtagttgagacagaggtcttttgcagtagctgcaaagcctaaaacatttactatctcattctttatagaaagtctttgccaatccatgtttatggtaacttgctgcaaccctgaattcacctaaagctaccaaatattctaaacttttcacctttctttatgcatctacgtgtctttatatttttccttttattttttctcactctccattaatattctagaatgatttggatatttgtaatattttagacacatagggaacactcacacttactagaatttcaattgtttcctttcagactaacatctttgtatatttcagcaattcaacctcttgcctttgtgtcttcagtttagcctgtctcttgctgtgcctttttttaattgagggacatcagtcatcctgcttctggaagcatcagagtggaacaatgcctgactagcctttttgacggattcttcataatcacgtattcatcacagaggctgtttaaagtgtgctcgttttcaagttattacaatctattcccatcatttttctgtctgtgaggcatttaaattttattaatatgcaaagctacttcctggcatgaggagaaatagacttcttcccttttatatctatttcaaattttgtgttttataatgttggttttggtttataatctattgtaatgatatattaactgtaccacatgcaccaaggatatttatttttttcccttgggatacttctctgtgcatgagtgttttcctcccaaatgtttaattattgtatgaagtatactgaaaatcagaagttccaatttgaaacatgtattcagaactataaatcaagaaattgacttaaggtaaacatttttaggaagggagcattcatgcagttatttcttttcagccaaatagccattctttccgcaatttatattaggttctgtcatgtgttccacacgttatgcttgacactaggaatacaaggtgactaggacacagattctggtcacagtcggacagacatacaaatagatgcctccaatatatttcagtatgatctacaaaagaaataaacacaaagtgctatgcgactccaggagagaaacgggatctaattctcacctgaggagtcaggaaacacctgctgtggaggtgacattgactcttgaaggatgaattggagttccacaggtggagaagagagaagagagtactttagttatgcttctttgctgcataggagccaacagagagggaacagttacaaacacaaggttgtaaggggatctagttgatgaggtgatgtatttactagacacagaaggaaggatacattgttttatattttaaggaactccataaaaccctcctctgaaaggtcatcactgacttactagttaacatcaacactggtctcttttcagcctttgccctgcttgatcactctggagccatttaattgtgttggttagtccttctttccttggttttcctgtcctctcttggtttgccaaatatttatctatagagaactacatagatttaataatcctcttggattctgcttttggcctcttcaactcttgctctgtgtttatttccccctgagcctagccacccccagtggccagtttctctctctctctctctctctgtatgtgtgtgtgtgtgtgtgtgcgtgtgtgtgtgttctagatggcttatcttgaccatgacacttgaacagccacctatgaaacatctccctctgggtgtacccagaacactcatactcaacaagtcccacaattaattcattgtctttttctcaaatactcactagatttgccacaccttcccctacactcacaagtaacacattttatagtcaccctagatttatggttcttactcagcctgaatatatgtaatatctctcctctccatatgctcttctccccctgtatgggccttatctttttcaggctatgatgatctatgatctaacaatttttctaatctctgtaccggtcaaagctccctaaccacaaaatttgaccctggctagtcaaagcagaaaagaaattttttaagaaggatataccataacgaacttggaaggctgtaggaccaggctcagaaatgggaagcatcatgcaaaatggagccttgtctgccatctgtcttgtcctattttctcaaacaggaatggtgttcagatgttgagctgcccaaagtattaaacatataatctagtttttctaaccctctgttaatagatgatattggtgctcttcccagatccacttgaccagcagaatacccaaatgctcagacacttgtgagcacttcagctgatggcttatgcctgtgaccttctcggaaggaatacccttggctaactgggacagccaatggctctgtgacacagaggtacaaaagcctggacccttccttttctctctgctgtgagatttatgctacaggatctgccttgtgtgaagacaaggttagacattgaccaagatcacttatttccttgactccttcccctgccctatcttgcactacgtgtttcctccagagcgcatgcctttaataaatccctgcctcaagctccgcttccaaggaacccaacctaagacccaccctcaaacagagttgatcaccttctcctttgtcttacctccatttatactacatttcttgctaatggcacttgccactctgtatggcaattgtttcttcatatgcctggatcttttaataggctgtagaacactggagtgcaggaaatgcaggaattttttctctcattaagccctagtatatatataaacaggaaattaaaaataataagttgaacttaattgaaaataaaagtcagatcacagtggattaaagaatgagtagaagtgaggtagtggaactagttattatagtgcaaggttattctttccaatgtccaaatgttccttggaatattattattggcctacctgttttatccaccaactagattgtggataactgaacaaaaatacatttttagtaattagtctttactcagaaggattttttacaagacataaagttcatgcaatctggttaatttcccaaatgagtcacatatattctttctttctttgttagctttgttattacttactcaggaaggggtcgcttttgaaatttgtgacttagcaatttcttccacttcaatgtcaaaaataacactgcatggccaaggctagggatttcatacatttctttagcatttttgaagcctacattccttatcactctagagacattatgtaaaattatttcatatttgacaaatgattccagtttgattatcattttgcctcatctatagaagtctgtgtgtggtggatgttggacagtctaataatttactgaacatttgctgtatacaaaatactatgctatcaattgttgggggctagcaggttgacaagtaatataaatagtctctatgctgaagaagattgagctagctagaattgtggcatagcttagaataatctacagaggacctcatcaatcaatttcaaattaattaataattgatgctgagcctgtaaggaccaagagggtacagcatgaggggatgattagcaagaactaggtcaataaacaaaagaagttttctggagagaagtttgcttaaaatgtgttgatgaacctcaatttaaaagacactttcttaatattcctgtctagccaatgccctccttcttgtctctaccctagaattcccaagacatggacaagaattcatagaattctgactatgccataatcaaacactggaaggaattgagtaggtggtgactagtctatattttaagttgagagtctcactgggctgccacttggtgtgatgccattggcccaagttctgaccctcatatttataaaaccacaggtttgactttctcagtgaacccaaaggtgaacagcttctccgtgagtgatcagcagactttttctataaagtataaatattttacaatctacaggccatattgtctttgtcacaactatttaactctgctgttgtggtgtgaaagtagccacagactatatgtagatgtggctgtgttccaataaaactttatttacaaaatttaaaggccggccagatttagcctacaggctatagtttgccactccctgttgtagaagattgactcacaccaacaatatttccaagtcattaatcagtcaccaataggactcatataagcaggacagattattactgcatctttgatcagaaattggccactagagaagctcaacttcaaatcagaagtttgtttagtaagcaacaggtgaggcaaatgaatgttttggtttgtgttcttacagaagtgaccctgatatggtttgggtatttgtcccctccaaatctcatgttgaaatgtgatatgcaatgttagaggtggggcctggtggaagtgtttgggtcatggaggtggatccctcatgaatggcttggggtcctccccatggtaatgagtgagttcttgctctattagttcatgggagaggtggttgtttaaaggagcctcttaccttctcctctctctcttgttccttttctcaccatgtgacatgcctcctccccctttgcaatctgccaaaaagtagaagcttccggaggcctcaaccgaaaccatgaatatgctggccccatgtttgtacactctgcagagtgatgagccaaataaacctctttgctttataaattacccagtctcgggtagtcctgtatggtaacacaaaatgaagactctgaggcaatggtttaaatgtaagtaatttatttggcagataatcccagcaactatcattaaggaaatagagaaataaaaacaaggaatggaaagaagccaataaaatttgcattattaagcaagatcaccaaagtcaaggagaacataatctccctgggagaatgtgcctctgatttataccagtcatggcacaagggagctgggatatttatccagtaactcgatccatcattggttgggggttgcttgtggggaggatcagaaagagccccactgtccaaagaaaggcttcaggctgagggttgtaggtgctggcagctggaagttggacagcatgtatgaacatggtaaatgccaaggggctatggagggagggcaccaacagcatctgttagacttgttttctcccaaatgatattcataaggtagcacagcttactgagtaaattttctattacaagattttttttctgtataaatggaactgctcctgtaaatccaaccaacatcctctccatggtatttgataggcattaacacatatttttaacagttaatccattttgtgaaatagtttcccttaaccatagttggtataatcccaagatagaacatattagaattgtcatgaatatagctttttcaaattgttttatattttgtttactaatatcttttttaatatttgggaatcatggggcttgggactgaaagtggaccaaacctcaccccactcttatttggccttggcgattcagtgtactatctgtgctctcttgccatatttattgctagaggcagccaaaggctggcctgtgggagtaactatggaaaacaagagtgtgtacacactctctgaggacacaccctagttttggaacacaaccccataaatgaggaactccacaatgctggcatgtccagggcaaagttcttaggctgttccattaactttgtgcaccacttccattctccttgaagccaaccaacagcagtctaagcctaacagttgagctcatgggctttggcaccatgcagacccaaggtagattactatctcagccacttggctttgctgcatgacatattcattcagacataaatgtcaataccttcctgggcatcctgtgaaaaatccactttcacaaaagcatttcaggacaatgtagactttcttaacatttcacagtagaggccaagaaagagttcacatcattttcctcaaagcaatcaacttaaaaatttcaattgacatttatattctcccaagtcccttcttggccttcctgatacaacgattttctctctgtccttcatacaatgctcaccgttataggctccattctcttcatccttcccctcacttcttttctcttccattgtgatatgcagttgagccccacttagctctccagctcatcaacataaagggttctccagttaataggacccacctgccttagaagagaagtgggattatgtgttatttgtggcaaggggtaagggatgagaattatttcatacgcctcatgtatccataaaggacttctacttaatatgtatttttgtgtgtatgtatgtttccactttattccctgagaactaatcacatgttggtaacactgccagcctctctctgctcctttgtctattcctttccagtagtgaagaagcacaacttttctgatcagaaacagtaagaaaaggaacaaagtagatgtgtatggcagccattcaggtgtggcacttgcagaacctctcaggaaagaatttgccactcagttgcaaggagtgcagctggttgacagcctccaacttttgaaggccacattcttctcgggaagcctagccaatgaggaaacacagaagaaatgctaaggcctgaccgtttctgccaatatgggactcaattaacaggaattatttgctttggagctgccctaggtgttgactgagactttgtcaaatctgcattgagatcccaggcttgccctgaccaaacttactttctccccttcgctcaatcttgctttctcacctctttcctttcataggtgtcatagccacagcatggtctaagactttccctgcccagttttgcttcctctccctttcatctttcataagatttacctccacatatactgtttgcactactaactctgtctcagagtctgcttccaaaaagacccaaataatacagtgtggctctacagctctacttctctttttctgtctctctgtctctctcttataatttgtacagaagattcaaacactcttacaatctccatgtgctgcatgtcttagggaatgtttttctgctacgagtgggaggctggattcttgggtatattgttaggggcacagttttggggggcccattatgactacatatctagtctcattctgcaattcaatcttaattcgacaaaggtgattttttatctctgttttattcctgtgttttatgtctcaattagtttgtgactctggagagaaataaaaagggctgctttatttatcctttccaccccagcatgaataggggttgaatatttaaaaattcttatatgtaatttagaagacttgaatgattttccaaaggccacatagggtattcattctgctctattcttatgaactcatttaaaaaattcatccaaagcatgatcttaaaaagtaatgaaaactgagcagagtgacagaaagaatttgattaataaagacactattgcaataattacttctgctgatggacttattgcttccttgaagatgtaaggatagaatgtatggaccgtgagcatgaggctttcctagaattttagtgtgtgtatgtatgctcagtgtgtgtgtgttgcggggtggttccttggtcctatacaggttgttcggaaagaggcactagcagaccagttttagggtaccagtcctttcacattcctgtctttgggaatcactgtgcatacagtttttgctgaagtgttggcctagggcactccaaccttccctaccagctgcctggcccagcttgcctcaggtgccttccctgtagtgtcactcattgttgctgccccatctgtaacctctcagcttatccaggagagcatgtgcaacttccgtggacagttacttcttcctatactaccagaggcttcttaccttaagtacctgtatttctgtgacctaggacattctctggctatgagagtatgctacactcacttgtgaggcaagccaggaagggccaggcaatttaatgacctagaagtgactttcacaaatgaagaacagaatttggtgggtacctctccaatttccttccttctcttggagggataattctagggcatgatgtctcatgattagcagcatgagagatagcaaagcctctcagcaggtccctagtggattgagctccctcgtaataactcactcatgaatgtgccttttattgaatgtcttcccctttctcatttttcccctctatgcttcctggtattactccttgctatgcactgaatgcttgtaacccctcaaaatttacatgttgaaatgctaatcttcagtatgatggtatttggagatgaggcctttggaaggtaatcaggttactagggcggagccctcattatgtgattaatgcactgagaagacacgagagaggttgttttcctccttctctgctctccaccatatgaggatactgcgaaaagactaccagtttcaaaccagaaagagagctctcaccagcacccaaccatgctggcatcctgatttcagactgctggctttcaaaatagtgaaaaaaatattatttttctttcagctacccagtctatggtaatctgttttagcagcccaaactaagacatcccctaaataaactgcttgtatctaaacccttctcccaggatcatcttttcggagaactcaagctaagatactacccccgctcttaccagattttttggggaaattaaaagaaagggtgagggtaagaaaacagaaaggagcagacatgtggaatttagcggagttgcagaaactatggagatttggggtgaagaacaaggaactcctatggtgactttctccaaaaaggctttgagaaaacaacccctctctattaccaactcccaaggcacagtctcatatccatgagcaaccccacttctagtttatgtgtgattcagttttttccaagctaaacctgcttgacttgacgagaaggccaaataaattcaagcttgctccaaacatgtctctttagatcaggttattctcatttgtaatgaagaaactgaggcagctagcaggttgatcattcgtaacactcttttttaactataacattctaaaatgtgggagcagctctcgtcccaatagcaatccatgattaaataactatgaagtttggaagttgggcctgtaaacatttctatagagagctacttcattcattttgttttattcgattcatgttagtttctaatcagttcccaaagagggtggagtatcctctttgaaggcccatagttttatatgacttcacctttctcagacaacccagtgatttgtaatcaagaatgaatatttctgccaagtaaaaaatgtttaacattatcccagcttagtaaggggaaaggcaggggataagggtgggtagcaggtagaaccttcattagagtgagatggctccctgaggaaaacaactgcaactgtgtttttcgagttctattctcaattttttgttttcttttttgagaaagagcctggctctgtgactcaggctggagtgtagtggggcgatctcgactcactacaaccttcgccctgctgggctcaagcgatcctcccacctcagcctcccaagtagttgggaccacaggcatgcaccaccacatctggctaattttttgtaattttagtagagatagggtcttgccatgttgcctgggctggtctcgaactcctgagctcaagctgtctacctgcctcagcctcccaaagtgttgggattataagcatgggccactgtgcccggctcaagctctgttctattcagccaattacctcagcacaggacagggcaaggaaatggggccggggaaggggtccctgttactatggttggtgccttgggaaatatattccttggggctattattactgcctattacataagtaagctcaattaaagccaggcttatcagtcaaaaatctctgcaaccaatcaataaaggactcaggatatgcaaaccgtagtgtcatccaactcatgtgtttttagattttgagataatattttttgaattcctgtagaggaaggaatacctacatagcattggctcctaagaaagtgactcagcaggccccatcaaagattgccattgaatcaggccgtagggtttggcaggaggaggagggctggagaatagtacaagctgagggctgaatcacactggctggcactgcaaagaaccccatctaactctagttaatgccagcattccatctagtttagctcacaaatggattttaggtacttcctgccatgtagactttcttgcttctcatgctgtgctgaaaataacctgctaagaaacctggaagacccccctccccttgcttaaccaaatgtcaaagatttattaccaataatggacaaactaacatcatgtgcctcttgttgtggtgctgtaacagggacacacagccatttaagtagtatttctgccagaagagtacctaaaccaactgtaatcatgaggaaacatcagacaaactcaaactgagagatattttacaaaacagcaggcctgtgttcttcaagaatgtccatgtcataaaacacaaagaaagactgggaactagtccatgttaaaggaggccagagagacgtgacaactaagtgcaacacattaacatggattatatttaggaggaaaaagaatagaatgaccagaaaaactttgttgcaacaactgtgaaaactgaatatggactgtatattatataataaagagcatggtatcaatgttaaatttctggaattggatacacgtactatggttttgtaagagaatttttttcttttgtttgcttttcttttaatatttttagagacagggtcttgctctgtcacccaggctgccttacattggcttggtcataggccactgtaaccttcaactcctaagctgaagagatcctcttgccttggcctcccaaagtgctgggattacaagtgtgagccatggtgcctgtcccagaattcttgttcttgggaaatatatgaagttagctgcatctgtctgtctcttcattcaggtatttcagtgtgtgtttgtgtgtctgtgacacacatttgtaaaatgttaaaaattgatctatctaaacgtagaaagttatgtgtattatactttataataacactttgacagagaaacaaggacatcgtaaaattgtacccagctggtgtaagtggtgaaactatcaatccaaatacatggaatattgtctaaagtttataagaaccaaatttatacaaattatatgttaagattatggcgcaacttaatggaagtcttatatttatatttgtatacacttaaatattattataattaataaaaacttaaccaatctacaaatgaagtgtaagaaatttaggtatttatcttaactgttttcaagataattaataaactaaaagtcttagacaaactacagaaagtcatgtgtattgtatatgcaactattttgcaagttttaaattatttctaaacaaaaatttaaacaataccaaattatttattattattattttatgaaaagtaaattacatacagaaaatttttctgcaagatcctgctcccatagtaaagtagaaagggaatgggcctggagcacctgagaactggttactcctagctccaccattaaataactgagcattgtgggagaaagtcactaaattacccgagactcaattttctgtaaaatcgactcctcacatttgcaggacttctcttcccacatcttcactctaagaacaccaaatcataaactccttttcaagtgtatttattctttattgattaatttaaatatagcacccttcttcctgagagcaaagccacaaaccaccaacaatgaccgacttcaaaataaatgtctgcaaatgcaattaagtgcattttagaatagacttgtactaacaggaagtataattaactcagaggcattcttatggagtaatcccaggtttgttatataggttcatttcatccataaagtcaggagaatacaattgagttgtacagaacatcagcatatctgacacattttaataagggagatacagattatatcccaaataaattaagaaatggcaaaaaatagtaatgaatagtttcgttaacaaattatgacatgatctgctggcaatattagtctgactcctactgatgcaataaggctgacagctagctgcaaaagtaattaatctgaacagaaattgactgtgaactgtgcttggcttaaacttggactaaccatcctgctgacctaagagaaatccatgcagtaaattgcttcaagagacacaggatacagaaaattctgctttaaaatggtaaagtatcattttcattttgagacctactttcaggcactaaattaaattttagatgacctcagcttttatcctgtctctaaaagatccaactcagaaatttgtcatgcttccagtttccaaaacctagtattggtagtttttctgagatgaattccaaggctcgttcagcttggttaggtaattatagttattatcatgaaaaaaactaggtcagatcagttcaattttttttcttttttcttttgcaaaaaagaataatatgtgaatgttttagacaggtcattttgtattcagcaactaactctggcttttattacttggccacgacattggtagaggtcaactgcaaagcaatgagcaggcaggctagagtaacttatgtcaggcgtgtgacagctgcatagtgttgcagcattggctttttcctcaacacggatatactgagctactgccccacctccaactctgtcatcttggaaaagtgagtttatttatttatccctaatatgttatttatttccttccttccttccttccttccttccttccttcctttcttccttccttccttcctttcttccttcctttcttttttttgactgagtcttgccctgtcacccaggctggagtgcagtggcgccatcttggctcactgcaacctccacctcccaggttcaagcaatcttctcccctcagcctcctgagtagctgggattacaggtgtgtaccaccaagcccagctaatttttttgtatttttagtagagatggggtttcaccattttggccaggctggtcttgaactcttgacctcaagtgatctgcccaccttggccactcaaaatgctgggattacaggtgtgagccgccgtgcctggcctatccctaatatgttctatctgtaaaatgggaatatgattttatttcctgaaaatcagtgactgaacaaagaaaaaagaacaaagagaagatagaacaaagagtttttactccacaaggaattgtgcatgtggaaatgtattatcttctttttgcttttccccaaagctcctctgaaatgagaggaaagcggatgttttaaagacagaaacctaaaagggtaagtacaataggagataagatatcagcaacacaatttggaaactggaaagcagtaaatgacctaggaaacctaagaaatgtaatttctaaactggcagggaggaaagctgagaaccaatctgatccacccagaagcaccctgaaaagcttaggactggtgctaatagtaaaccctgaaaattggggtgaggacagggctaaaagcagaaggattaggtgaacttctgtgtacaaagcatttggaatccagtacacctccctcaccatgtgcagcatttggctgtcctgcccacactcaagcaacaactggggattagtctatggagaggataaggcaaggaatttcaggaccagagaacaccgggcacagctgagatcagaagtactgtgtgaaaacttggggattaaataaacatttatagacaaaatttgagatgctgcatctcccagatttcttcctccactcagctcctgtagcaatggcagtctgacttgtgacctccaggcaggttattggatagtccttctctgtagatgtttacattaaatgttccccaagggaataggacagtcatgtcaccacattaccatgttacccacactcggcaaaacccaactaactcccatagagttttcagtcagtttttcaatacatcatatttaaggatgaacagataaaccaaataaagtaattttctgagaaaatcctccagactgaaagatggaggccaaaaaaaacaaaacaaacatacaattaaaaatggaatgtgggaggacaaactgaatttgtaaggagaagataattttaaagaataaaatttcactgtgatgctagtttctctcgctgtgcagaagctgtttagtttaattagatcccatttgtaaattttggcttttgttgcaattgcttttggtgttttcattatgaaatctttgcccatgcctatgtcctgaatggtattgcctaggttttcttctagggtttttatggttttgggtttcacatttaagtctttaatccaatttgagttaatttttgtataaggtgtaaggaaggggtccagtttttgttttctgcatatggctggccaattttcccagcaccatttattaagtagggaatcctttccccattgcttctttttgtcaggtttgtcgaagatcagatggttgtagatgtgtggtgttatttctgagggctctgttctgttccattggtctatatatctgttttggtacaagtaccatgatgttttgattactgtagacttgcagtatagtttgacgtcaggtagcgtgatgcctccagctttgttctttttgcttaggattgtcttggctatatggtctcctttttggttccatatgaaatttaaagtagttttttttctaattccatgaagaaagtcaatggtaacttgatgggaataacattgaatctgtaaattactttgggcagtatggccattttcacgatattgattcttcctatccatgagtgtggaatgtttttccatttgtttgtgtcctctcttatttccttgagcagtgttttgtagttctccttaaagaggtccttcacatccctcgtaagttgtattcctagttattttattgtctttgtagcaattgtgaatgggagtcactcattatgtggctctctgtttgtctattatttgtgtataggaatgcttgtgatgtttgcacattgatttttgtatcctgagactctactgaagttgcttatcagcataaggagattttgggctaagaccatggggttttctaaatatacaatcatgtcatctccaaacagagacaatttggcttcctctcttcctatttgaatacttttatttctttctcttgcctgattgacctggtcagaacttccaacactatgttgaataggagtggtgaggtgagagagggcatctttgtcttctgccggttttcaaagggagtgcttccaacttttgcccattcagcatgatattggctgtgggtttttcataaatagctcttattattttgagacacattccatcaatacctagcttattgagagtttttagcatgaaaggctgttgaattttgttgaaggccttttctgcatctattgggataatcatgtgttttttgtcattggttctgtttgtttatgtaatggattatgtttattgatttgcttatgttgaaccagccttgcatcccagggatgaagccaacttgatcgtggtggataagctttttgatgtgctgctggattcagtttgccagtattttattgaggcttttcgcatcaatgttcatcagggatattggcctgaaattttcttttttttgttgttgtgtctctgccagattttggtatcaggatgatgctggcttcataaaatgagttagggaggagtcctgatttttctattgtttggaatagtttcagaaggaatggtaccagctcctgtttgtacctctggtggaattcggctgtgaatctgtctggtcctgggctttttttggttagtaagctattaattactgccttaatttcagaacttgttattggtctattcagggattcgacttcttcctcgtttagtcttgggtgggtgtacgtgtccaggaatttatccatttcttctaggttttctagtttatttgtgtagaggtgtttatagtattccctgatgatagtttgtatttctgtgggatcagtggtgatatcccctttatcatttcttattgtgtctatttgattcttctctcttttcttattaatctggctagtggtctatctattttgttaacctttccaaaaaaccagctcctggattcattgattttttgaaggtttttttgtgtctctatgtccttcagttctgctctgatcttagttatttcttgtcttctgctagcttttgaatgtgtttgctcttgcttctctagttcttttaattatgaggttagggtgccgattttagatctttctcgctttctcctgtgggcatttagtgccataaatttccctctaaacactgctttagctatgtcccagagattctggtacattgtgtctttgttctcattggtttcaaataacttatttatttctgccttaattttgttatttacccagtagtcattcagaagcaggttgttcagtttccatgtagttgtgcagttttgagtgagtttcttaatcctgagttctaatttgcttgcactgtggtctgagaggctgtttgttatgatttccattcttttgcatttgctgaggagtgttttacttccaattatgtggtcaattttagaataagtgctatgtggtgctgagaagaatgtatattctgttgatttggggtggagagttctgtagatgtctattaggtctgcttggtccagagatgagttcaagtcctgaatatccttgttaattttctgtcttgttgatctgtctaatattgacagtgggatgctaaagtctcccactattatcatgtgggagtctaagtctctttgtaggtctctatgaacttgctttacgaatctgggtgctcctgtattgggtgcatatatatttaggatagttagctcttcttattgcattggtccctttaccattatgtaatgcccttctttgtcttttttcatctttgttggtataaaatctgttttatcagagactaggattgcaacccctgctttttttgcttcccatttgcttggtaaatatctctccatccctttattttgagcgtatgtgtgtctttgcaggtgagatgggtctcctgaatacagcacactgatgggtttgactctttattcaatttcccagtctgtgtcttttaattggggcatttagcccatttatatttaagtttaatgttgttatgtgtgaatttgatcatgtcattatgatgctagctggttattttgcccattagttaatgcagtttcttcatagttttgttggtctttacatgtttttgcagtggctggtactggcttttcctttccatatttactgcttccttcaggagctcttctatggcaggcctggtggtgacaaaatccctcaaccttttcctgtctgtaaaggattttatttctccttcacttatgaagcttagtttggctgcatatgaaattctttgttgaaaattcttttctttaagaatgttcaatattggcccccactctcttctggcttgtaaggtttctgaagagagatccacgttagtctgatgagctttcctttgtgggtaaccaaatctttctctctggctgcacttaacattttttccttcatttcaaccttggtgaatctgatgattatgtgtcttgaggttgctcttcttgaggagtatctttgtgctgttctctgtatttcctgaatttgaatgctggcctgtcttgctaggttggggaagttctcctggataatatcctgaagtgtgttttccaacttggttccattctccccatcaccttcaggtacgccagtcaaatgtagctttgatcttttcacatagctccatatttcttgggggctttgttcatttcttttctttattttttctctaatcttgtcttcatgctttatttcattaagttgatcttcaatctctgatatcctttcttccacttcatcaatttggctattgatatttgtgtatacttcatgaagttctcatgctgtgtttttcagctccatcaggtcatttattttcttctctaaactggttattctagtgagcagttcctataaccttttatcaaggttcttagcttccttgcactgggttagtacatgctcctttagctcagaggagtttgttatttcccaccttttgaagcctacttctgtcaattcatcgaactcattctctgtccagctttgttctcttgctggcgaggagttgtgattctttggaggagaagaggtgttctggtttttggacttttcagcctttttgctgtggtttttcctcatcttcatggatttatctacctttggtctttgatgttcatgccctttgtatggggtttttgcatgggcatcctttttgctgatgttgatgctattgctttctgtttgttaggtttccttctaacactcaggtcccttttctgcaggtctgctggagtttgctagaggtccactctagaccctgtttgcctgggtatcaccagtggagtctgcagaacagcaaagattgctgcctgcttcttcttctggaagcttcatcccagtgaggcacccaccagatgccagctggagctctcctgtatgaggtgtctgttgacccctgctgggaggtgtctcccagtcaggaggcacaggggtcggggacccacttgaggaagcagtctgtcccttagcagagctcgagcactgtgctgggagatctgctctcttcagagccgacaggcaggaatgtttaagtctgctgaagctgcgcccacacctgccccttccaccaggttctctgtctgagggagatgggaattttatctataagcccctgactggggctgctgcctttctttcagagatgccttgcccagagaggaggaatctagagaggcagtctggctatagtggctttgccatgctctagtgggttctgcacccagttcaaatttctaggcagctttgtttacactgtgagtggaaaactgcctactaaagcctcagtaatggcagactcccctcccaccaccaagctggagtgtcccaggtcaatccagactgttgtgctggccgtgagaatttcaagccagtagatgttagcttgttgggccccgtgggggtgggatccactgagcaagactgctcggatccctggcttcagccccctttccaggggagtgaatggttctgtctcactgctgttccaggcaccactggggtacaaaaaaagaactcctgcagctagctttgtgtctgcccaaacagctgcccaattttgtgccagaaacccagggccctggtggtgtagggacctgaggaaatccccttgtctgcgagttgcaaaggctgtgggaagagcgtagtatctgggccagatagcactgtccctcatggcacattccctcacggcttcccttggctaggggagggagttccccaaccccttgcacttcctgagtgaggtgatgccccaccctgcttctactcgccctccgtgggctgcacccactgtctaaccagtcccaatgaaatgaaccaggtacctcagttggaaatgcagaaatcaacccacttcttcactggtctcactgggagctgcagactggaactgttcctacttggccatcttgcctggtgatccaaaatcatcttttcaacaaaactatttcttctctcagctgtactttgtcaacatgttaaaaatacccttggtaatttacctgtgcattgataactaactatgacggttctcagtctttgttgcttattagaatcacctgggcaatttaaaaaatatgcattgctcagaacacacccccaacacgttaaatcagaatttatgtgggtggaatacaggcctcagtagtttgtaaagcttcccaggtggttcaaatgtgcatcctgtactgagaaccagtgaactagagttttattactcaaactgtggtccatggactggaagaatcagtatcactcagaaacgtgtcagaagtacaaaatcttaggcctcattccaaacctagaaaataagaatctgcatttaaacaacatttgcaggtgatctacatgcatgttaaaggttgagaagcgttattttagagtgctcaaatgaatcattggggttaataagatcaaggtcatgagtgttacctttgttccaacctccgttttgctgtgtttgaggcagacagtcatgagcatttgtgtttaacggtttctgattttaaggccatgggtgtggatagtcttttgtgtccaaggtagatgcatgtttgtaatgatctcccaaaggcaagggatgattctgtttcttgttaggagttcctcattaccccaggaaatcagttcattaataatattgattactctgccaccatttatgaacctcattccacaagacccttcacaatcagattctacttacttcagtcacattgccgcaaaatcccatggtctttcacaaatctgtgttgattcatgttacacagtgctgggcacaaagagagccctcaataaatattagctagctattattacttctgccttgaaatgggaaaacatctcagctggagcatctttttccctccttcctcacctggaaaatgcaaatttagcattcaaaaactgaccctgcgtagctcgccctaagtgccctcaggtgagggtccatcctgtatgccacctcctgtgattagaattaatctgctgtgggtgctgtagcccttcctactctgggcgctccttcagaagagggaccagatgtccttgaacatctaggactcctaagccctccttaaatatgtatataatggatcaataattgaaaccaaaaatcatctccccgcatggagatttgccatgtacatggcagagtttctactcaggcaaaatagaaaaccactagaaaacatctggttttgaaaatgatggagttatgagatgcattttttatgaggcagttacggtttaaaggaaaaattttaaataatgcattctgtaaattcctgaactatagtctttacttcatctatatggcttccaaggaaaattccatattaaaagaattggacttttattgttttatgcattaatttattcactcacttattactcaacagtaaatcactttaaatatctattctaaagaattatatgttttaaatgcctacaatagggcatgaaaatatgaaagtatcaccccctagcaggattaagtggaaatatcatggtatgataataacttacaaagagagatagtgtatattttgcaattaggcaaaatattccacatttgctgtggagagcacaaggatccctttttaggggattttgtggcccttcctcattttggtgtgctttcaacaaccagggagcttttcttcaggaggaagatgtcactcgggctactggaactgctttacaatgattgcagatgcggaagtatgaaatcataacttctttgattcagatttggacaactctgaagggtaacttacactccagagtttactcctgataacatgttgaagctatcctctgtgagactggatctaaaatggtactttgacttgtcattttatcttttcctttttgcttctctcattcccagtagaaggtcccccagtctcccaggaatatctttactaaatccgttgcatgtcagtcctcttctcagggtctctttctgagaatcacgacttaaggcactttttaatgctatatttctacatagatatataaatacacatacatagagttttacacactcagcattctttaatactttttttattttgcatttgtcaattagtcatttatgtttttatatatctgtattttccattgggttaaagggtccttatgaatgggaactgatttattcccattgtgcccctgttctctgccctctccctaatccaatacctcatagactcccatacagagtaagtgctcaaagatgttgtttgtgttttttcaaataggatagaatacacattcattttatacacatatgcattaattaagaaagtcaaatgtgatatctgaagaactgtaaccacatgttattaaaggttcttttttctgggcaggcagagcatatatttagcagtgttatgcttaaaaataaccaagtgaaattttctttgaaatgaatttatcattaaaagtagtttaatgtaagaaatggtgaaaataattataccactacaaattctgtcttttggactattttgtgattaatgcctactaaaattattcaaatgtaatctgacagatttttcaaaaagccataattagaaatgaaaaaggagataagaagtttcatcaaatctcttttctttgccatcaaaactagtcttacccagtttcctttcatgaattctgttcccctaacatattttcagttcagccacatttgggatacagacatgcaaaactctcacagcacgcaaatgagattagcaacctggttgccgagcaaaatgcaccttttctctatcgcctagcagggacatccccctggacaggaaaagtggcctttcctgagtatgtctgctttaactccattacctacaatgccttgggatattcttcccatcaagcacttggacaatgaatttcagaagtcatcctatcagattaaattgatctctaccttcaaccaattcccatgcaaattaggcttccataaacatgtagcatgaccaaaagaaaaagctgttgcagaaattctaaagaacctaaagtatttttttcatcacttgtcacacgtgttaaagaaaagtcatttttccatgagcttccccatgcctgagttgctgcctcatgccagctctttataaaagttcacaattgtttcaatgtggttgttgctattttcactgtatagttcttcattcatcgtcatggttggcccttaatacaaaggtacgagaaagtattaccggaggatagcatgctactagcatcagggtatgtagacagaaatgtgactttctaagataaggccaaaaaatgatggtgcctttgtgcaagagaaaagtgtttttctgtttctttcaataattacctatatcacaatcacttgggagggcttgttaaaaacaaaattctcaggatccattctttgaatccaaatttctagagataagaccattccatttatcaagctccacttgaccatcactgattgccccaggagtaagcctatgactcaaacagagctaatgagagttcttccttagaattttaaatttatggccactggactgggtgctacgtgaggatctggaactttgttttgctctctgatatatctctatccccttgaataatgatggttacatagcaggagcttattaaattgaattagtggagtaagtctcagtttccctttgatggacaacattgtgaattgtgaggcagccatattcccctatgcttagaggaatacaaacagaatgagactgttctaacaacactcaagttcctaattccagttgtcttttctgcctagctatttccctgtcattcccctggctttatgagccaatgaattgtccaaatttgcttaatttgaatttcaaactaaagcagtttaataaacatagctaagatcttataatctcttattttttaattattttattatatttttaccacacttgagcttacaaccaacttctaaaatagatttaaaatctgagatgctaaaaagtagagaagacttgcctcaggtcacatgctagtgtatggaaaaaccggaaataaattttttattaaatcttccttcttggtggaaaaggataagtaaaacttggaggagattgagaactttgaggtgtttttacctgtaatgctttccaattagcttagcattatagcaaaactggttcagtgatgatggagggtttcagccactgggcacttgcagaaatctcattgtactaaagacagattatctgatacattgttgtctaccccaaataaatgtattatctgtcaatggaaagtaagagtaaggggaatcactgatgttaacttaatattaaccacaaggaaaaagtgggtagtgatggtggtaattcagaagtgttaggaataggaagagtagtacattgttgtcatacacattgtctgacatagatcctggatatgtctgggctcatatttgggaagcagttatttcataattctcacagacaggaataaaccctttgacagttgcttcataagtgtgggggtgaaacactcaaacaagctgggaagattttgcttgcccagcagcccacagcctttgctttggcatcaacaccctaaattttcattggggaatcacttctttcccactctcataacatgttcccaggcataagcatgtgaccaaagtttggccaaccaggttggttctggaatgggcatgtgaccaaaattaggccaaagagagtcaaaatcttgagagaaacactccttttcttcattttatttatttattaaatttaacttttattttaagttcgaggtacatgtgcaggtttgttgtacaggtaaacacatgtcatgcgggtttgttgtacaaattattttgtcacccaggtattaagccttgtacccatcagttatttttcctgatcctctccctcctcccactgtccaccgccccagtgtctgtggttcccctttatgtgtccacagagaaacactctttttctatgaagattgctaaactgtagaaaaagcctgcctcaaaatgaatccaacctggggtgaggagaggacaaggaggaagaggaggcaggagaaagggagaaaaatttcacatcattattttagcacttagtgtaagccatgccaggatctcttggtttcaacccatcagttctcttttggagaaactcagggctagttgagttcctgcctaatacagaggcagctgaagagttcattgaagttgcagagagaatttgctgaaagacaaagatcttaaaaacacaaagatgagatggaggcaactaaccaaatatgaattggaggaatggcatgaagcccaaaaatggcatcagaaaggcagagagagtttaggattattaagtaaacacgcaaaaacaagacacaattcctttcttttattctctgagaaagaagagacaaaaagttacaggagtattggttgttccataagttgatagaaggaaggcaaaactattccatttcttttatcttattttttcattgaagaaaattaatttcaaactgaaaaagttagaacaacgaagatcaggaaaaaagagaaaccctggacacttacaaagatcagaggttatatcagtctgaaaataacttttgctgatttaaacagaaaaggaatttattaaaagaaaattgtgtagctcactgaaactttgggagggctggaaagctgggcagaggctgaggggcaggaatgtcgctctaaatcaccccacataaaagcctattgaggactcagttgccaccatcactatgtaatagatgatacagtttctgtcagaactaccacagcatgggacatttcatgctgccactaagaccctgtctctgcttccctgggaattcgatcttgagacagccaaactttccacccaaggtgaatctccatagtcacagatatttggcatggttagcttcaattcaaagcctgatagtactgacaagagcatctgattggcagaatgttgtcatgtactcacatcctagctgcaaggaatgttgtgaaaaatctgaatgtggcattttcaattatgtaaaaggaagtgaggtctgacctccactaaatctcatgaagtgagaattccaagaaataattgtcatgacaaaagtcattaacctttccctctatgttttcttctaggagttttagcatttcaggtctcacgtttaagtctttattctatcttgagtttatttttgtatatggtgcaagacaaggatctgatcattcttttgcatgtggctatacagtattcctaccaccttaattgaagagagtatccttttcacattgtttattcttcatagttgaccatatatgggcaggtttatttctggatttctagtctgtttcattgatttatatgtccgtctttatgccagtaccatactgtttttttattactgtggctttgtaatatatttttaaattaggaaacatgaagcctttaggcagggtgcaggtgtaccattgtgctggcggggaagggaaggctaggtctgcctgggcatatacgcaccagcatagcaatgtggagggtggccatcagtgcaaacgagctgttgtgtatttgtagagaccactctgctggagcactctgccagtcaggtgtggtccaacaacagctatgaggtgggccccaagtggcacctggcagctgtgctgcaagcagttgtggccaggctggggccccacaagaggccagcagactgagaggtgctcaggttggactagatctgtctcatgggtaagactgccctgtagagttcaggtctgaaaggtcccctagggttaagtctcctatgggagcaaatctagcctagggggatgcacatctctgactgttctccactacagttgcttccacaggacaacctctgttctctgcccctggctggagttctgcccctactacttctctaagtaactttccctgccaactcaagtgtccgtggtggtcgaggggtgtcctcctgctgagatttcaaaggcccacaatgagagtgtgttgctccttgcctgttaaactcaccccctctgtcggagtcattgggggccaggaacacgttccagtgcgcaataaccctgggaagtgttcctagcttcctcccacttcagcccagcctccacgttttccctccgtctgctctgcttacaactacaggataagaacatggcagcactgggatatgaactcatttctgcttatctccaaaggccttgctcattcatgcagactctcagaaatgaaaaataattcccttcatctttgttaaatcacatgttcctacagacaaattctccaaagcttttatgaaacctatgtgatgctgtaataccattgattactacagtatttatgaaatataccattcatagctttaggctacacaggcacagctacatatcaagctctcttgaattctctctctttctaaaacctatgaatttgaagtcaggatattttcagaagtccaactggtgttaaaaatccaaatagatcaaacatcgtttctgtttatatctgtgtgacaactaataccaatgggtgtaattacaatgtggaaaaacccacataatttctgaggaaagtttatttcactggaagtagccgttaccaataagcaatagaaaccctaaccagtggctcttattttgcaattacactttttcatcttaattttagtatatgtgcagccaaagcaaacaccactttttcatgttaagcaatggctaagactgtgtgtgatataggtgaaggctatcaccagataaacaccatcaaaaagttattttttatagtgtctttgggttttgattttttagtatccttcttcctttccaactccatcctcctcttccacaaatataggtttagtattaattctaaactaaatgatgcctgaggcattaggcactacaataagtaatcctttaagtcccaccagaatttgagtttgatgatatggtgtccattgtgtagatgaggatacatcctccgtgaagtgcaaggtcacataaccaaatgtgaaaaagtaggtctgtctcttgctgaaaggaactgaacattggatgctgctgcatgaagcccaaggcttcagtggacaacctcagaaaccagtaactctgagccatatggcatgatattggcctcccagaagtctgaataatatgtatggggatttcccagattttgaaggcattaatgactcatttctctaggataccgatgtaagttcttcagtggaagaaaactggaaaatgagtgtctttgtctacagacataaggtcttaataaaagtaatcatgaaattgaccttggtggggagagcaatgaaacaggattacatggcctgagtgaagtcctaacaatacaaaagattaggtacaaagacacaaagataagaaaaggaatattgactggagtctggaatgcaggagcatgtgtgtgtatgtgtgtgcatgtgtgtgtgagtgtttatgtacctagataagtttagcctggagaattaacaagccatgcttgtgttttacaaaaatacactcaagaagagacatgggttggaaattattgcagaaatacaataagagatagtggtgacatgaacctaagtttatgatgatgaatttgaagagaaattataggccttggcttagaaagcaacataaaaaaagacttggttcttcaggaacacaatgtccacagaaaaacttcactagaaatagaatttgcacatagacagatgtatatctcactgcttacttggatgaaatatatgcatatatgcccatttacagatggactctttcatctctgaaagaaaaagtgcacttcagatctacactacagatatatttacctacaaatttacctataccagacagttttacctgctatgttttaaaagtaaagcagttgcttaatttattactttaaacttatgagtgcattttaaattgctaagaatgaaatgaaaattatttgaacttggacagatatgtaaggatacttgatgttgcttggtagcttttctcatacagatctattttgcacatgagatttgccagggagttgaagctacctcctattctgcacctgtttatatgatttggtaatagtcttttgtagtgaaggtttatgaacatggtgaaatgcatacattcaattgagatgataaaatggcataactcaagtttcaactatgattttgataaatagttttcaaaccagttttgggggtttgatgtaatcccaaaggggaagataacaattttactattaaaaattgttaacattaatttggctatagactccaatttttggttaacaaaataattgtcataattatttcattacaatttcaatataaatagagttataagttctcgttttactcagcacattttggtgtttttgttgttgttgttgtttgtttgtttgttttttgcgagggggtcttgctctgttgcccagactggagtgcagtggcatgatcatggctcactgcagtcttaacctcctgagctgaagcaatcctcccacctcagccctctgggtagatgggactacaggtgcgcaccaccatgcctggctgatttttgtattttttgtagagaccaggtttcaccatgttgcccaggctggtcttgaacccctgggctcaagcaatccatccacctgggcctcccaaagtggggagggattacaggcatgagccaatgtgcccaactccatttctgtttttaagaataattcttttatttctggttttatgtatttttacaaataattgacatgataatgtaatattcacaatgcttcaaaaatgtgaaaaagtatatgtgaatattaatcacataattgataaaatatatgaaataatgaagccaaagcaggtcattaagaaatatttataaacattaggtattgaatttacagatgttgccaaagttgtacatctacagggccagtcatcataaattctgattgatgtttaaaatgagagcaagaaatacccaattaagtagtaaattgaaaaccatctaatcttcttccgatacgtctgtgacgtcttctttctacttgtaaagtctcattgcacgttgaacaggagtcttaacagagtcataagtccatcccttcctggcacacagcctttcaatgatgccaggcatttcatagcccttgcttagaatgaaatccttaaaggcaattggtccataaagatcgtcaagaatatcgggttcatctggcttttcaagtaagagcttggggtcaatcaaaggttgatcacttcttagctttttccccagcttaggcttaaggtaccatactccatacctcatcttcacacactgtgcagtgtaagaattcggtgccatctggagtttcctgtcccagtctttttcctgtgaggattcgacctcatccatttcatctagctttattctgtattgcagctctgagacccattcttttatcttcttaatctgttggtcttcataggttgctctccacttgggggtaaagtcaaacagattcctgatggattcttcatcaactcccatgtctcgagcccacttgaagtcatgcatttttctcgatgtgtatctatgttgaagagagtcagaaacacattctgttgtgcttggtgtatcttcctgaagcagttcttttagacaggacgctcgaatcttgggaggctccaagaagtgatgggacactggagctttgggaggctctggggagagatgggacactctagtcttgggaggctccgggcggagactggacacctgacgagtcttgggaggctcagggcaaagatgggatgcctgagtctctggaagccgtaggcagaattccctacaagactatttaccaggcttggtgggttccttgattgtcttctcccggccctcacaataagcccatgccttctccagcttcctctcaggatccagcagtttcagcatctgtagtaggagactggacacccaactagtgttgggaggttgggaggttctgggcggagatggaacactacagtcttgggaggttccgggcagagactggacacctgcatcttggggggctccgggcggagactggacacccgatgagtctcgggaggctccgggcagagatgggacactccagtctcgggaggctctgggcagagactggacacccgagtcttgggaggctctgggcagagatgagacactccagtctcaggaggccccaggcggagactggacaccagagtcttgggaggctgtgggcagagatgagacactccagtcttgggaggccccgggcagagactggacactggagtcttgggaggctgcaggcagagatgagacactccagtctcaggaggccccaggtggagattggacaccagagtcttgggaggctctgggcagagatgggacattccagtctcgggaggctccaggtggagactgtacatccgagtcttgggaggctctgggtggagatgggatactccagtctcaggaggctctgggtggagactggtcacctgagtcttgggaggctctgggcagagatgagacactccagtcttgggaggcccagggcagagactggacactggagtcttgggaggctccaggcagagatgggacacctgagactcgggaggcctcgtgcagaattccccacaagggtatttaccaggctcagtgggttccttggttgtcttctcctggccctcacaatgaacccattcgtcctccagcttcctctcaggattcagcagtttcagcacctgtagtaggagactggacactcgatgagtattgggaggttccgggtggagatgggacactccaatctcaggaggctctgggcagacactggacacctccgtcttggggggctccgggtggaggctggacacctgcatcttggggggctctgggcggagactgtacacccgacgagtcttgggaggctctgggcagagactggacacccaaagaatcttgggaggctccgggtggagagtggacacccgttgagtcttgggaggcttggggcagagatgagacactgcagtcttggtaggctccgggcagagactggacacccgacgattcttgggaggctccgggcggacactggacagccgaccagtcttgggaggctccgggcagagtctggacacccgacgagtcttgggaggctccaggcggagatgagacactgcagtcttgggaggctctgggcagagactggacacccgacgagtcttgggaggctccgggagaacactggacaccccacgagtcttgggagactccaggcggagatgagacactccagtcttggaaggctccgggtggagactggacatccgacgagtcttgggaggctccgggcagagactggacacctgaagagtcttgggaggctccgggcagagatgagatacgcgagtcccgggaggctccgggcagagatgggacactccagtctcgagaggctccgggcggagaccggacacccgacgagtcttggcaggctctgcgcggagatgggacactccagtctcggggggctccgggcagaggctggagacccaatgagtcttgggaggctctgggcagagataggacactccagtctcaggaggctctgggtgagactggacaccggagtcttgggaggctccgggtggagatggaacacctgagtctcaggaggcctcgggcagaattccccacaggggtatttaccaggctcggtgggtgccttggttgtcttcttccagccctcacgagcccatgcgtcctccagctgcctctcaggatccagcggtttcagcacctgtagtaggagatctggaggcatatcttctcccagattggggtacatggccaagggatgcttggccatcagctgggcttcctctacaaatgccttccatgctggctgggctggcaagagcttggaaaacagggccactttcttgagcagctttttctgcctgcttttcgggtcagcttggggacctctgtgagagattttggggagtaagaactcgttaagtctacaaatgagcatatcttcgggagacggacagccatagtggaagctgtccatgctctcctttacaaatacccagttctaaatttacaagaaaaaaatcaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaacaagttcaaccattgtggaagacagtgtggcgattcctcagggatatagaactagaaataccatttgacccagccatcccattactgggcatatacccaaaggattataaatcatgctgctataaggacacatgcacatgtatgtttattccagcactattcacaatagcaaagacttggaaccaactcaaatatccatcaatgatagactggattaagaaaatgtggcacatatacaccatggaatactatacagccataaaaaaggatgagttcatgtcctttgtagggacatggatgaagctggaaaccatcattctgagcaaactatcagaaggacagaaaaccaaacactgcatgttctcactcacaggtgggaattaaacagtgagaacacttggacacaggaaggggaacatcacacacgggggcctgttgtggggttgggggagggatagcattaggagatatacctaatgtaaatgacgagttaacaggtgcagcacaccaacatggcacatgtatacatatgtaacaaacctgcacgttgtgcacatgtaccctagaacttaaagtataataataacaataataataataataataaaaaccaaatactcagttctgggtgtccattggcgggaacctcaggcgcctgtgcttacgcttcgcgatgtacttggaaggcggtttgtcacagtaccagggcttgcagtccatgcccggggacctcggccggtcccgcggcctctggtcccccatggtggccctcgctggggtgccatctctccagttcccgcggttcctgatccctgccactctagtcgctaggagaccgcgagccacgcgcagcccaggttcttcctcgaagaggggcagcggagacgccatctgcgcagcctggattctccagggtatggtcagcaacggagtgcccaagcccctgctcattccatggtgtgtggtccatgggatggacagagcgcagtttctttttccattcgcctttggatggacatttcggttgtttcccgttttggactatgacaaatattctatgaacatttgtgtccatgtcttcgtacgtacatatactttcatttctcctggataaattttagctaggagtccaatggcgggatcatatcataggtgtatgtttaacgtttttaagaaacgaccaaacttttacaaagtatttacactatttcatattccttctactagtgtaggagcattgcagttttttcacctatgatccaacacttggtatggttagtcattttaattttggccattctaataggtgtttagtggaatctcattgtggtgtttatttgcatttcataatgactactggaattgaacatctgtatatttgcttatttgcaatctttatctttccttgggtgaagtttctgtacaatttcttttccatttttaaattgtgttgctggatatcatatttcgttttgagaatccttgctgtgttctagatgtaagtccattatcacatatatgatttgcaaatttttcgcttcatccttggcttttccctttcactgtcttaacagtgataaagagaagttttttaatttgatgaagtccaacttatcaatttgattttttacggattgtgcttcttttgatgtatctgtgaaaactttgcccgcccaaagttcacaaagattttttttatttaaatctgtttaattttttgtaaacagcacacgatatagatcaaagtttttatttgaaaaaacgtgtctattgcctatgtacatacgatacatttcagaactatttttgtaaagactatcttttgtccactgaattacctttggaaatttgtagaatataagttgtctatattttttatgggtcaatttctgggcactcttttccagatttttctctcacacaaatttcgcactctgttgattactttagctttgtaataaatctagaaattagtctgtattagtcctttaacaacattcttttacaaagttggttcttctaggtcctttgaatttctataaaaattttaaaatcagtctgtcaatgtctaaaaaaatcctgttgggattttgattaggatttggttgaatccatagatcaatttgaggataattgacatattaaaaataggaagtcttctgaccactgaaaaaggtacatttttccatttgtttatgttatttttaattttctcaggaatattttgtattttttagtgtatacaactttcacatttttttctctccagagttttcctaaatattgtttttgatactgttattgttatttaaattgcaattcccaattttttgttattagtatatacaaatattgatttttgtatatctatcttgtatcatacaaccttggtaaactcacttattactttcaggagcacttttgtagatttcattgaattttctttatatatgataatgtcatctgtgaataaagacagtttctcttctttctttcaaaattgaatatctttatccccctccagtccagttggaatccttggttttcctttgaatcatatcagttaaattcttatctctcttgtgatgtttaaaacgatacctacgaaaaagctttcttttaaaaaaattatagacaaattcagcttgcattattcctttaccatattttctcagcacataataatttttttccatacattcttatccatttttaaaaagttttcttatttcccttgttaggtgcagctgaacaatattttctaccattactagcaggtataccctagttcctccttgtaaatgaggcatgatcaatgcctttcttgcctttggctcgtcctctgtaaaataggcacaatgtatattcctcttaggtttctcattaaatccaagaaatggattatgtgtaaatcaagataatctatataacatgattttgtatagtatctggcacagaataagcatccagtaaagtactgttattttatataggattactacaatttgaaaataaaatattctacattcaatgtctaaataaaggagaagcagaaatcatacagatctatttacttgtcacaaatattttcatttatcagttataagaatctgttaaactctcaacatatttggtagattttacaatgcatagttggtaagaccattttgatatggatttatttttaactttcttacttggaaaaattccatggactgtatgttaaattcaagagccaatgcttcaacaattctctataacagtactctaactagcaagctcatatgagtattcacttatctaaaatgggtgagggtttgaataaaacttctatattttaaataatcccagagaaaaacacacactgaagctcctaaagggcaactgggcatcttcaaaatttttcatgtgactgttcattaaaacagtttttgtaccttacagccacttcatttttttcacttttcaaagtagaatattatacaaaagactcatatccagaatatataaataattattaaaatgtaacaatgagacaacagagaacacaaaacaaaaatgtataatacatagtagtttaacatgtatagagataaatagctaaagaaataattatagttgtgtgtacatattggttagtatacatgcatatattttatagttctgtctgctgagaaactcgaaaaaaatatcacctaagtagccaaaagtacatccagtgtccagatcttggtttctaaataccattctccaaaataacaaaaacaaaacagagatatccttggagaaatgagtaattctaggctgggggcagtgaaaacacaagatgagcctggagtattatgtaatgccagaaaataggaagttctcagaaaacaaaagaataagagcagatcaggagccaaactaaaagagcattcaatggccaaagttaaaacaatttaagcaacatgagaattaaactttaaaaattataacacaatataaaataaaatatccatgagtccatactgatacaaataattgtacaaataaataaatgacaaaaaggtgcaactctgtcttagaagaatttcaaaaaatgtacatagatacttctccccccaggaggtggaatttaaatgccctccccagagtgtgggctggattctaaaaaattgaatatggaaagggaaaaatagtaacattttagtggagaagcctggcagtcctctccttaaccaagtgatcaatgttaatatcagcagtgagaagtcacgttggtatcatgcactcctctgataggatgtgctgagaaagactccacctctgtagtattctttcctaaaatccagaatcctagtctaatgaggagaaaacatctaacaaacccaagtccagggacattctacaaaattctcaagtactcctcaaaaccataaaggtcatgggaaacaagcaaagtctgagaaccagtcatagactttagattaaagagacatgaaaactaaattcaatgtggtaggctgggttggatcctggtgctgaaaagggacatgggtataaaaaatctacaaatctgaataaagtctgaagtttagttaatagtaatatgtcaatgttaattttttagtttaaatacatgtacaatgtaagatattaattttaggggaagctgagcaaaatgtgcatgaaaatgctttgtacagtgtttgcaactggttcataaatcaaaaattattctgaaataaagggtttccattttaaactacatattgcatcatgacaaattatcagcaaatcactattaatcatacaagagagaaaggtgtagcgtctttaaaatgcatacttgtggcccctctctccttatatatagtaaaacataattttttcgaagtggagccagtcatctacattttacatggtctctagattatacacaccaatatgtgagaattacttttctaaagccctgtgccttttataggccccaaagactttcaaagatttaaaaaaccacagtagttatggtattatccaaagtcacaaaatttggagaaaattaaatttcagcaagtgctatatgggaatgtaaaaatcagacagtggagcctgtggacaaaataattcacttagatacacgtacataactggtggacccacaggataatgaagtcatgatagaagagtaaagaagatacaaagtttggtgagtacctgactggcagtgaaaaaaaactaggagtgaaagcaacttacttgtgcaaacagcccttcttgggttaaagaaaactgacatcactatagagttcagagaaattacaactggcctgttcagtcaacaagcaacaactgccttagtatgaagtgttactccagaaatgaataatgtagcttgcaagcaaaaccaacatcaacaagctaataagtaatgttcaaggaagtcaaaatgctctgagcagagtagcatgtaatgactaagtatataagaaaattaaaataaacaatgaaaatcaatgtgatgaagtgcattgatttaatggagtcaaaataatcccagttctgacatcttcgtgtgcctctgactgctcttagttacctacaacctttactgcagacttaactcaggacaccattttcatgctccagcagactcatgttatcttcaaccttgctgcctcttccacccacatgcggcacctgccagcctttctcagatactcaatcattttcattctgatccaacccacttcagaattattttgcttttattagctcttggtaagtttactttctgtgatgattaattttctgtgtcaacttggctagactaaggtgcccaattatttggtcaaacagtctagatgttgctgtggaggtattttttagatgtgatttaacattttataccagtagactttgaataaatcagatttaccctccataggatgggtgagcatcatccagtcagttgaaggcctttaggaaaaagacaaaagatccccccaaaagacggaattctccctccagactgaaacacagtaatccgtttgagtttccagccattagaatcaagactgcaacatcaacttttgcctgaatttctaacccgcaaccagctctgcagactttggatttgccaacccccacagttgcataaaccaattccctaaaatttctctatctatctacctacctatctacaaacatatatgtatctatcctattatttctatatatataaatcttatatcctattatcctatataaccccctctctctcatatatacacacacacacacacacacacacacacacacacacacacacatatacacacacacatacattttctcatctttctagagaaccttgattaatacactattcgttttgatcatttttctaccagtaacaatgttcatatcttgtcttatgatgagatacactgcagcgattttaccactgctacacccactgagaatttttctcagcaaggtataaaatatagttaaggaataagaaataatacagacttaaagatttccattttgctttttgaatcaaaaagcatagaagaattattccacacattggctgaatatcagaatcacttgtggcccatcttaaaagtatatatgccaaggttctaccccgagcctgcagaatcaaaattcctcccattgataatgattcacagtcaagggctgaaatccctggatacatagtaatttgatcacagtatctcagataggatatagtccagcactaccgttattaataaagaatttgaggcaaaaagagaacaaatgacttacacaagttctcaaaaggtaagaatgaacagtgtcaggttaatatttttcatatttctagaagattcatcctattttctggtatagataaattccagaaaaatatgacagtattcctgtctccttgtatgcacatttgtcatctggtccattgttccaattcacaaatataaatatattgcaatatttagaaaataattgagcagtggcagctctattttataaggaggttcaggtacaaatgacactctctagtatacagttagaggacttcacaaatggctaaaatcttggcaattttgtgtgttgttaaagtaataaaactttgaggacaggtaaatgttactgtgtcatatcctctgatttaattaaaaaagactgctctcactttcctattgacagaattttgtagatgcatttaacaaattgtcattattcgtagcttattttctagtagcaagcaaaataattccagaatcacttcatatcacggatatgaataatgtagaataaccaataatctcagttgtccatgagtgctgatttaatcttattccttggcttctaatgcaaaatttgcatcttttacagaatttccaattcacagagtactgtacacatatacacataaccagctgaaagacatgttctcagctaatgtccaacattggaagagcaggcaaaaatatgcaatattagtattatttacagacagattgttaccattttaacctcgattttgaaatacagattgttggccaggcacacggtgcctcaagcctgtaatcccagcactttgggaggctgaggtgagtggatcacaaggtcaggagttgaagaccagcctggccaagatggtgaaacctcgtctctactaaaaatacaaaaaaaaatttagctgggcattgtggcgggcgcctgtaatcccaggtactcgggaggctgaggcagagaattgcttgaacccgggaggcggaggttgcagtgagccgagatcatgccactgaactctagcctgggtgacagagcaagactccatctgaaaaaacaaaaaaaaaaaaagaagaaaaaagaaaaaaagaaatacaggttgttaattctatgttaaaaccacagctcttaagaataacatatatatacatatatatttatgtatatacacacacatatatattcataccacaattcacataaaggtccaaagtttagctggttttaacattagtgatcaaagcctaatatatataggcaaatgtatgcattcaatacacatgtgaacacaccacagttttctaagatattattgaactttttacaaaatgttaattgggttgtgattttataaaaatagttctaatattatattactatctgtgtgttcatttgacctaacagtactccttacaaagaaaagagtctgaaggatattctgcatcatcccgctgtgaaacagctttatgatgccaagtgtcccatacagagatttactccaatgaactggtttaatttagaatgtgacctaaccaattatatttaatagcatggctaggaaaatcagccccatagtctaaaaaccagtatctctgggaaaaaaattaagtagacttctggttttgcacaggatattgtgattgctatttccattgctccttttacatttataacaaatgaataagctgaatatgatttttcattttgtagccacaatctctgtagacaaactgatcaactgaaatacttacattgatttggtcaatatatttatcaatgaataatgatttaggaagttattttcatgatttggacaattgtgcacctggattcatttacaaactattgtctttttctaatgttagagatgtttgatgtgaggaagaaaaacttaaggagggagactcacatggaggaaattgcgtttttctctacagcataattcaggaatacattggattagaagtcaaagtgatgatttggaaggaactaaaagcaccgatatttgatagagacctggtgaaccagggaagcaattctaaatagactattttggatgtggaacagatatttccagtcatcactggagtttttagtccttgacagtgatttaaggtcttcggaatgctaagcaatgttacaatacctgcacatacaacacagtcatatgctttgccaccagtagctgctctcagtgttgcaggacttgtccttagttcagctaaagactagctcctcgtccgtcccacagccatgaaaattcaggcttgctgacggtttgaagggtgagcaaagcagagtcttattgggtgaaaagggaaaaagggggaagagggactctccgcaaggccagagttcttgcccgtgcacttcccacctcatgctgtttaaatcccaggttctacacaggaagaggtggggccaggcttctccctgatgcaaagggtgcgaactcctgtgtctccacccagtgtgcaggctggttggtgttttcctgggggacctcctcccacctggctgtcttattcccccctctaaagaagtacatctaactgctgttagaataaggataaggataaggataaggataaggataaggataaggataaggataaggataaggataaggataagaacgaagactgatcttaactgcttcctgctgacaaggggcgctgttttggggaaatggcagccagatcgccctcagagcagaaggagcagagtcagaggctctggttttatgaccgtttggagtttgatggcctgaaggcaagaacagataatctgggttattagaaagcatgtgtcggccaggcgcggtggctcaagcctgtaatcccagcactttgggaggccaaggcaggcggatcacaaggtcaggagttcaagaccagtctggccaacatagtgaaacctcgtctcaactaaaaatacaaaaaattagccgggtatggtggtgtgtgcctgtaatcccagctactcgggagggtgagtcaggaaaatcacgtgaacccgggaggcggaggttgcagtgagccaagattgcgccattgtactccagcctggccaacagtgtgagactcctcctcaaaaaagaaaaaaggaaacatgtatcaaaacgaaacaaggggaagggtaacaacagctcaaaacttataaggcccttttaccagtttgcatggggacggggagaccaaattcccagctggtaaaatacttcacccatttgccagtatgttgggcttctcggttccccctcccctgagcctaaccccaagccaaccagtttaaagtttgggaaattaactctttccagtttggaggatgcatctgagggaagtgctccatagtacagggacacaattacctattagtgaagagaggacagaggaggagagaagaaaaaataagatacttttttttttcaaaggagtcccaggggttcaggatgcattcgaaaggggtacagactgaagatgaatggctacccatctagaaagaggggagcaggcatccctggttcccttctctgcctgacagatacccgaggtacgtgagagagacagggaagagagtcctctttgcctcttctgtccttgcatccccaagtcctgtcaaccttggcagatgtggccatgagtgtaaaagcggcttgcacccatgaagcagggggtcgaacgggtgggaatcatctgctccttcccacgtatgccctatcttccctgctatcggtagccttgaattctctagacctcatttatgccatggatactaatgtggcctttatccatgaaacaggaagcttgggcttggcttaatcggcaggaatcagccacactcacgtgcactgtgccttttaacctctgttgtcgtctgcctctggatcccttagatctagtcttctttcctagggctttgactcaaagcttggaattagtttgggacaaaaatgtatctcatgggggtgttgcatggactccttatcataagctgaatgctaaggtgaaactgtggaactgagtcctcctccaacaagggagagagaaaaggatgtcctgtgacacacccaaacacctggtggctatagttatgcttgctaggatttgggtgcatggtgtttgtctttggttagctggcttgttcttactttcccaaaaggaaacctccgagtaatgagcatcctattgattccaatcccctggcaggatttgcaggataattgctcagaattagaatattgatccagatttttacattatccatccctcttgttctttctgagctggagccagagattgctggttggttcacaggaacaagcagggttagtctaaaaggtaagtgaaaacttaaaaacaactagtgcatttagaatttaatgacaaatgtatgataagttttggaacataatttctctctctccagtcctcatgtttgttaaaaaaacaaatcatcataggactggcggtttttgaaacagaccttagtcttatacttggcctgattatttgcataaagtgcagcaagaatgattctttctacataggtcttttggattggctttgatggagctctattccccaagggatctcaggtaagaccttttaaagctgagcccagccatgggtttaacctcaaatacctgtgagttgggcgatccttgtctcttaaggtcccaagataaacttagaggtcctggatctggtatataattgctcacagtagtctcttataatccttttatttccatggcgtcagttgtaacatcatctcatcgttttctgattttatttatttgtatcttgtgtctttttttttttacttagtctaaaggtttgccaattttcttgatcttttaaaaacaccaaatcttttttcatttattttttctattgtttttattctctattttatgtattcctggtctaatctttgttctttccttctttctgctaactttgagctagtgtttccttctttttctaatctctttaggtgtagagtgagattgtttatttgagatatttcttcatttttaatgcaggcatgtattgttatgaacttatctctgttaactcaagtttatcctaaagctgcctccttatatattttaagttcagcctaaaggtttctctgtatattataaagtataacctaaatggagttgtacacagaccataccctacttttctgctgatcaccaagttttggccaaacctggccaactgttcaaatcatgttcaaataaggcaaactatgagctggaaccaatctgactgtttctatacctcactttggttttctgtatgtcactttcctttcaatgtccataaatcttcttctaccacctggcgtgctggagtctctgagcctactctggctcaggagactgcccaatttgcaaatcgttctttgctcaattaaactcttttaaatttaattcagctatattttttcttttagcatctcttagtattgcttttgctgcatcccataagttttggtatgttgtgtttacatttttataatattttgtatgaaatatcttttctccattctttcactttcagcctatgtggttctttaaatataaagtaggtctcttgtagaaagcatatagttgaatcttgttttgtttaaatattttttattcattaacctattttatagttatagttatttttatactttgttacttctgtcttctaacttccatacaaaaattaaaagtgatttgtgcaccaccaatacagtatgacagtattctgtatttatctatagtcacctgtaccagacagctttatacttttatatgctttcattttgctgtttagcattttttatttcaactttaatgactccgtctagcatttcttgtaaggcaggtatagtgcggatgaactctctcagattttgtttattttggaatgtctttagctctccttcatttttgaagaaatgttttgctaactatagtatttttgttggcaagttttttttttttttttcccattcagcactttgtacatatatcatcctactccttctggtcagcaaggaaatcctctgagtcttattgaggttcactcatgtgggacaaatcgcttttctcttgctttcaaaattctgtatctttggcattgacaatttaattataatgtatcttacatggatttctttggattcaccttttttgggatccattggcttctagaatctggatgtcttttttcttccccagatttgggaagtttggggcaattaatttttaaataaactgttttttttttctctttctctttcccctctgcaacttccataatgcatacaggggtctgtttgatagtgtcccataagacccttagattttgttcattctttttcattcatttttctttttctcttattgcataatttcagattacccatttttgagtgcactgattctttttttctgcctgatcaagtcagctgttgagcacttctagtgatttttttctatcactgtagttattgcattctttagctccaaaactttctgcttcattctttttttaaaggaaatttctctctacttcgaaatgtcattttgttcatgcatcattttcctgagctcattaaaaatcttcatgacaggtattttgaattcacttttaggtaattcatatctgtttctttaaggtcaatttctggagatttattttgttctttttttttttcattgggccatttttccttgtgtcttgtactttctgtgattttgtgttggtatctgggtatttgaaaaatcagccaactctcccagtctttaaggattagctttatacatggaaaaatcttaaccaacaagcctggctagagattctgggggcctctcaagtcttttctgtgaatatgtcttctctagacatgtgtgcagattcctaactagagggatttgccagtttcttgttttaaggagcttgtaatctcttgctccttctgtgtctttttgtttcacgatgggtcatctgaagcagaaacatgaccatacagtctagcccttttttacttgcagtggaaccccaggtatctaaagtatgctgggttctgtcagctccccacatcaagatagacagaaaccagtacctcaggcagtcccatgaaaagccagatgttgaacacgtgttctagtcttctatttctccctgaataagaaactgccaacctctattgacctctgtctgctgtaccatgattcctgggtagcagcagcgtgatgcacagctcttttttgttgtcacggtcccccaggtatctagaatgtgcttgcccctgttagtgctcccagacaggtgggcaaaagccagtccctcatccagccccctggaaagtaaaaacattggaagtacagcccagtcttttatttccctccccagggagaagccagaaactagaagctgggagttttctcccaagcatatggcactctattgggggagagattatagcatgagtgccatgaattttcatataggcttggatgtgactggctttgtacttgtctggagtgcaggagccccttaactggtgtctggatttctcacagagggagttagtccatgttttattgccaaatctgtctccatgggaggaaggaggatctaatgcttcccattttgccatttcatgatgtcactctctgtaccttgggcttttttaataggagagagaaataaacttctattgtgcttacaatttttttgcatttttatttttgatgcagctaaatctaatcctaatggatacaaagagatcccttctttgagtggtagataatatgatactttaaaactttacaaatctaggagtatataagtctaagattcagtgcatttttttctcccaaatattttatgaaaaagaggaactttaaaataataatgagaatatatacaaatataattcccaggaaagaaaatcctcctctttatttttggttttacagacaggaaaataatgggcctcatgctgttttggttaactgggaaaaacagaggagatgtctggatagtaacctgttagctagcctcacactccacatctctcctttttgggttgtatacttagcctgcatcagaaacaagaatcagcttgtattaaataaatggtctcactttatttatatttaatcatttgggaaatgaaatagaaccattagaatagataatagatgtcagttttaaaaataaatactgaggcaaaataaatttctttacttttccatgacatttttctggaagcaggagcctattagactgttacgatgttctattccattgacttatctccaggttcccttttttaaaagactcgatcttttgaaatgcctttacattcaccatttatatgtacttacctacttaccacttctgcatcactagtactctgtctgaattcaaattttgtatgtctcatgcaaaactcaaaatccaactgtgcagcttcttgaccaaaaaagatgggggggagtgctgaatgtcactatctaaataaaaaagaattttactgagtagtggtggcctggagattgagttatgtggaggttctaattgtgaatttcaagtaaatatgagtaagccacccatttggatggcacacagaaatatactattaataattttctggaacatcttaattgaaagagaaaatataattagaaagtgaagacactcattttatttctcaactgagcttggtttgtataccttctagccaaaaataaagcaaatttcttgttcagtatttccagaagcagctctaataactaaatatccaaggacatcttacagaggtttttttccccaaagttgtgagagcttggtaaagatcaactgtgggaaacttctatggaacttaaaagattgaaaacaactaagagtcccccctcagatattgtctgcttatcctctctttgcagatctgctcattcacatagctttctgtcacatgcttttactttcctgtttactctttctgctgcagaaccagacagccttgaaaagattaactttattctgtgtcatgcatcaacaacacaatttgtcaacttgaatctttattaccggtgatcacataaaagctgaaaaacacaacatgatttctttcttcacctagaagttgaatttgtcaccctaaaaaaaattgctaggcttgtaaacggaacacattttatttaagaatcattcagaaagaacaaggaaaacagactggaaggagccaagatggccaaataggaacagctccagtctatagctcccagcgtgagccacgcagaaaatgaatgatttctgcatttccaactgaggtacggggttcatctcactggcgattgtcggacagtgggtgcaggacagcgggtgcaacgcaccaagcatgagccgaagcaaggcgaggcatcgcctcacctgggaagtgcaaggggtcaggtaattccctttcctagccaaggtaaggggtaacagatggcacatggaaaactgggtcacttccaccctaatactgtgcttttccgatggtcttagcaaacggcacaccaggagattagatcccgtgcctggcttggagggtcccatgcccacggagcctcactcattgctaacacagcagtctgaaatcaaactgcaaggcggcagcgaggctgggggaggggacacattcaaagctgtgtgtagagggaaatttatagcactaaatgcccccaagagaaagtaggaaatatctaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaatcgatgaatccaggatctggttttttgaaaagatcaacaaaattgatagaccgctagcaagactaataaagaagaaaagagagaagaatcagatagatacaataaaaaatgataaaggggatatcaccaccgatcccacagaaatacaatctaccatcagagaatacaataaacacctctacgcaaataaactagaaaatctagaagaaatgggtaaatttctcgacacatacactctcccagcactaaaccaggaagaaattgaatctctgaatagaccaataacaggctctgaaattgaggcaataattaatagcttaccaacaaaaaaaagtccaggaccagatggattcacagccgaattctaccagaggtacaaggaggagctggtaccattccttctgaaactattccaatcaatagaaaaagagggaatcctccctaactcattttatgaggcgagcatcatcctgacaccaaagcctggcaaaaacaaaacaagaaaagagaattttagaccaatatccctgatgaacatcgaggcaaaaatcctcaataaaatactggcaaaccgaatccagcagcacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttaacaaaattcaacaacccttcatgttaaaaactctcactaaattaggtattgatgggatgtatctcaaaataataagagctatctatgacaaacacacagccaatatcatactgaatggacaaaaactggaagcattccctttgaaaactggcacaagacagggatgccctctctcaccactcctattcaacatagtgttggaagttctggccagggcaatcaggcaggagaaggaaataaagggtattcaaataggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaataacagacaaacagagagccaaatcatgagtgaactcccattcacaattgcttcaaagagaataaaatacctagcaatccaacttacaagggatgtgaaggacctcttcaaggagaactacaaaccactgctcaatgaaataaaagaggatacaaacaaatggaagaacattccatgttcatgggtaggaagaatcaatatggtgcaaatggccatactgcccaaggtaatttatagattcaatgccatccccatcaagctaccaatgactttcttcacagaactggaaaaaactactttaaagttcatatggaaccaaaaaagagcccacattgccaagtcaatcctaagtcaaaagaacaaagctggaggcatcacgctacctgacttcaaactatactacaaggctacagtaaccaaaacagcatggtactggtaccaaaacagagatatagaccaatggaacagaacagagccctcagaaataatgccacatatctgcaactatcagatctttgacaaacctgacaaaaacaagaaatggggaaaggattccctatttaatatatggtgctgggaaaactggctagccataagtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaattaaactgaagagcttctgcacagcaaaagaaactaccatcagagtgaacaggcaacctacagaataagagaaaatttttgcaatctactcatctgacaaagggctaatatccagaatctacaaagaacttaaacaaatttacaagaaaaaaacaaacaaccccatcaacaagtgggtgaaggatatgaacagacacttctcaaaagaagacatttatgcagccaacagacacatgaaaaaatgctcatcatcactggccatcagagaaatgcaaatcaaaaccacagtgagatactatctcacaccagttagaatggtgatcattaaaaagtcaggaaacgacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggattataaatcatgctgctataaggacacatgcacatgtatgtttattccagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaaggagagcacatggacacaggaaggggaacatcacacacccgggcctgtcgtgcggtggggggaggggggagggatagcattaggagatatacctaatgtaaatgacaagttaatgggtgcagcacaccaacatggcacatgtatacatgtgtaacaaacctgcaccttgtgcacatgtaccctaaaacttaaagtataattaaaaaaaagaagaaaaaagaaagaaagaataaggaaaactaacaaaccaaaaatgtatgactcttttctaaggagaaccaacttagaaaaagaggaagaggcaagaggttaggcggtaagctggcagtgataatccacttctcaaagcaactacatacagaataataatgattttggacaaatgctaacatttattcagagctagacataaagttaaacctttataggcattatcctaaccatgcttcgagaaagatcccattgtctttaccaacttacagatgacagaaccaaggcttaggaaggttaaataactttccctaggtcacacagtgaggcttggtggagcaggagtttgacatcatgcctcatttcaatacctccacttgttcattgctcaaaggctcatagaattctctgttatcaataatcctctcaaatgtgacttcagcaaatatttttcttgctcccatccatacctacctagctgctctaatcgaatcacagcaaactacttcaaatggccaaaaaaccctgaattattccaggtctccttcttttgcaagtgacagacccctatttaagtaaaagaaggaatgtattgggttccataattgaatagtctttcagggaaggccagatgcaggcattttaataatgtcattgggtcacactttttgtcatacttttttttattataatttttgttttattggtttatttttcttttttattctaagacatcttgttatttatagcatgtcatactttttttattactcagttctgctttcctctgtgtggtttaatcctaagcatgctttctccttgcagtcataagagagccagcagtagctgtgggtttaatccttctacattagctatcttagctttcccaatggttttagccaaggaagctcaggattgcttctccttgggcagacctgggatatatgctccctcttggggacatggaaatggtatagcttcttttaaatcacatgttctaggaatggggaatggtggtatctcaaaataaactcaagatgttgctgatagtagaagaccattaaagccgggtggtcaagcttcctcattctgaagtctagctacatacctttatccgtactatccctatattaaccaatttccaaagctcacctctatcaacctccttgttgttctgaatttttaaccttcaggacatattgttaacattttattgctttactgtttctctttttacatcatgagactgtaaagccacactcaggttttaaaactgaatgagctattatccttcttctttatgcctcatatctattccactgcatgtattctttggcatggtggatagtacctttgttggtccaattgtccagagcagaaaccagccataatctttgacttttatcctcctttactcccacatccagttgctcataaaaccctgtaaacctgctcgcttcagatctcttgacttcttccaagtctcgccacccttcctgctattgccctagtccagatttcctcatttcttgattattctacttactgctctgacatatggtcctcctttaaatatgttctctaatttttcaagaaaactcatcattctaaagcacagatatgatcccacgactctcctcttcagaacctttcagcgattccctgttgtatgatttccatggaccttggtttccttattgataaaggaaaggcataaagagatgatctcttggagatgatctccagctccatgattctgttaatccttgccagcctaaagcagttagctctgtttaatcatttggtaatggatttgtctaccttttggattatagactgagaccctgttttttgctggttattgcccctttctgtatctcaacagaatgctgggtcaagtcctgtcgagcagtcatcgcatattgagaacagctggctacgtatgaccatggccattccagagtcataatatgaattatttggaagatatctgctcttttaagtaccacctcttgcattcatgcaaatgtataaaaattgtatatgagaattactttgaccttacatgtttgacattggaatttcttacaataaggagaactgtgaatgtgcaagtgaaaaagaaataagacaaaaagcagatgtgttaatgtattatcaacactaggctattatcaggttatttaatagccattgaactataccaccataggaatttataatcactcttttccttctacccttctgaatgctggtgaaaaccttagaaatgaccacatgtaggaagctcttaaacgtttccagttaaataatttactctacctaaaggaatatctacatccccacttgccaatttaatgtaccttacacagatacattagtttacaatggaggaatacctgttttagcagtgtcccatacagcaatgttatattataagtcattcaaatcactcatccatacacacacattgtaatacccaaaggtataattgacatatactttcttcatatccactaagctagggtgtggaccattgctccttcttggccaatgtgacctaatcaaactcagttgcccctccttcaggtggaatggcgagtgccaatttgcttgcttatttcaggtggcttttaattctgggattacatgtgtactggcgatcatgattagcctataatggctaacaaagtgccctaaattgataaaatgggaagtagagggaaaaaaagacaataaagagaatcaaatcctatgttagaatgcacacttctgtggctgcttttggcagaggtgtataatcaagcaactggtcaggaaattattctagtggagtaatgatattacaataaataacgctgcatccaaattaagtataggacaattagaggtggggcttcaaagaaccctaatacttcaccctaccctgtatccataccctttgtcatgcaactttgacattcaacaaaaacaccttatatttcctcatgtgatttgccaatagactaaggcagaaaagagtgtgtggtcctgagactagaccctcagaagtcttgcatgtctctgcttttgctttagcccctctgccattgccatgcaagtatgctggggttggccagctaaaagacagcaaaacccagccatggatggaaagaaaattttgacattatgaagagcatcacagacatcaataaatatctattgagcacatacaatgtgtcaggcattgatctagatgccaagcatacaagaggaaacaacacagacaaaatttcctgttattatgggggttaaattttagtggagagagatagatgggaaacaaaacaaataggtaaaatatgtagtcattagatactaatggttggtggaggggtagtaactttaaactaataagttggagaaagtctcattgaaagagaggtgaagaggcaagccatgaggtaattttttgaagagtattcaaaggacagaaaactgcaaaggaaagaggagaattagggaaaagtttccaattatgttgttaatctaataaaatagggatgagtcaccacagaggatatgctataaggaatgaagaaagcactattcagttatctcaagcatttctaggatgcaccctttgaacaaaattttggaaaactttttgaaagcatttctaggatgcattatcccataaaatgtattaaatcttaattggtaaggtttgacagttatacaattactgattttttttcatattcacccatagagagcaataatttgcataagagaaaccctgattttaatactctcttttctggatagttttgcataatttttatgcgatttccttgatgaacccaataatactctcttccatccatagttttgcataatctgcataataaggacgtactgaagaagaactaggaactgagcaattcagcaagatcacagaaacatgtgttgggagctgcctgtcagcaaatgctgctagaaattctgtgactatcaggacaaatcttgcagataatggtaaaataaatggccttggcaagattttgtatagactgcatatttcttgtggggtcatcactacttttaaagaatccaactggaattgttatttcagaacacaacgttttgggtgcctgcatacttctctgtcttccagacttctctaaaatatttatcttcctaactgctcattgccctgttgagtgtagactattgattagaggggacttccagagcattggattatgggaagctagcaggacattccagttaccttgctccataacacattatcctaaaacttcgaggcttataacaactatatttttgtttgtaattttttgggtcaggaattctggaagggtctgggatgatggtaatctgaaggcttgactggggtggatatttccaaagtggttcactcacatagctgtcagttgatgctgtcctcgggctgtcaatccaagcacttccaggtgacctcttcatgttgtctgggcttcctctcgataaggcagcttcagggtagtcagattcttacaaggcagcccaaggctccaaatgtgagtgctgcaacatttaagatggaagctgcattactttttataattaagccttggatgccatacggtgttatttccatcacattctattggttacaaatgagatataagcccacccagaattcagaagaggttgcatgtacctccctcctgatgagaggaatgtcaaggtcacattgattgcagaggaacatgtggcataggagatattgttgtggccatatttgaaaaatataagctgccacacagggttaattagcaaaagtagaatgtgtgaagaccccgaattcaaggtaaagtatagaggtcaccatatcttgtagagaaacagacaagagcaaaaactgcagaatgtttacattcttgtgctcacaagaggaaaagggtccaagaatataggaggagtttagacatgtcaggctaaggtttcaaaaaaggcctcactctgtgttctatactttagggtaccttaagtctctcatggcactctcatggtaattcattcattatttcataaactttcagtaaatatctactacagggagtagtggtagtagtagcaatagcagtagcagtagtagtggtagaatagagactattctaggatcttgcatatcagtaaataaatgcaagaaaaagccctaccctcatggagagtatattctagtggagtagtgatattaaaataaataacactgcatgcaaattaagtataggacaattagaggtggggtttcaaagaaccctaacgcttcaccctaccctgtatccataccctttgtcatgcaaatttgaagttcaacaaaaacaccttatatttcctcatgtgatttgccaatagactaaggcagaaaagagtgtgtgctcctgagactagaccctcagaagtcttgcatgtctctgcttttgctttagcccctctgccattgccgtgcaagcatgctggggttggccagctaaaagagaagagacatatgggccagaggccagtcacctcagtctccccaagcaagacccaacccacctccagacacctgaatgagcccagccaagatcctagatgcataaacattaaatttactgccatatgctattagattttgtgattgcttttcatacagcattttggggcaatagacagatgacacaactgggaaaaagtggaagagctcgttttcttggagacgtgtttacacacagttctattttgaagccagttagcagatccctgttgttgttgctggcgctacctctaggctggagtgtttcgaagaataatcagagtcagaattaatagagttgcctctagattcatgacaagggtgagtgaggtgtggaggaatgaagtggaataaggcttcatttctgctggtaaaggctttattttatgtttccttgtctgaggggacaaaaatcacctctaatgtctgttatggttgagggatgaggaaggaagtctcaaggagaaactcaacattcctgttgcttctttgatgccttttcctcctttaacatatcaagctccctgcctaaaagtggacttttatcattattattattattaaaaataaacctgttttggcagcatcaaagggggacgatggccatactgtccttgaactatgtggatgtgtcagtcctggcaatcatgttggcaaactaaggttctttcccagactacatcaagtaagggtggaggggcagggtatttaatatctgcttcccaatcatggtgacatttaacacttctgaggaaaaaaaaatgcctccaaactggcctttcaagtaagtggagtagttactctccccacaaagtatcagaaactgttctatgagccacttactcctttatgtcttgcacagtccctatcaaaagtcaaatactcctgggagacgtgacctctttagtcttcaagagtcaacactttgggaaaggcagaattatttcaaacagctgagcacaagaaaggcaactagcttgtgtaattgttcattttctgttttttcctactgaattgtaagctacaaggggtctaggaccatgtctatcttattcatccctctatttccaggtttcaggacacataggagaccctccacaacgcccttgggaaaaaagcagaagaggacaaacatgggaaaagaagggagggaagggggagataaaaagcctaattaaattctcacagagcgtttatcctaatattaactagttaatgacctcaagatatgtattgagcttttactatgcacgcatggcaggaggggcgtgccccttccttgccttaacctggtgtggttctttgactttttactcctgtatactcgaagaaaacaatacaaaaatcaaagctgggaaaaaagttcctgtatggggtatttcaccgttttaatgcattaaacatgatgtgctcaaatgccccagcctttgggattgaaacattcataatgagaactccgaagcgaccaagatgaaatacaaacttcaaagaaggcgcccagttttgtcttgctactctagcctagttcagtggcgcctcaaactttaatgtgcatgcgaatcacctggcaatcttgctgaatattcagatttggagtcaataggtctggagtgaagcctgagatgctgcgtttttaacatgcccccgggtgatgctgatgcttctaacccaaggaccacactttgagtatacaagggactggagaccatcacctctaccgccaggtgtgtgtatgctgagtcccagcgttccagatcagtgtcccgcacgtcctcggccttctgccagtaggggaggagtcgggggcggagcgggaggagtggcgcgggccccgcgtgggtcctgccagagatcacctcggccccttgaagaggcagccaagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtaagaggtagcccgggccgcgggagggcgctcgccgcctgcccggcctcctttccccggactccgtggctcgggcagcactgtcccgagttgctctccaagtctttgttactcttggtgtggtgctagcatttcttcagtcccttgaggtctatctcctgcttttgtccctcttctttcctgtcgttttcagtctctcatttgttgagattcggcgtctctgcgctttgttcgtgtttttacgtggcatcactccagatgcctgttagctttctgggggatgacagtgtggccctttcaagtaagatgaaaacctcagaaatggaagggatttcctttcctttgactctgctgtcaaaagctgaggcatcctcgaatgttagagtgctagaaagtaatggaacttttcggggccgatgtggaggtaagttgcttctggagccctgggtctgtaaccaagaataactgctcagctgtgggtctgatgtgtttactgttttgcttactattcagttcaacccatggctcttattaaatgcatatctgataggagtgtcccctttaaaaatacataaatgtagacggaaacgtacccggaaatgtaccccattgtggttgaatgtgcattatttcacttaaaaatatttgcttaggatgggcaagaccacagctttcttgacagggcagcttttcttgatgaataactttacagtggctcctaaaagtgaattggttttcacatacatattttttcctggactcactttgaaatcagcatgtggttattagaagagaatatgccagttcctgtggagtaggaaaaagaacaaaactctgaaggatcatagtgactagaacggagagagaggcactttcattcataatcccctggagccaactactgttctagggaggaagtgacacatttaacttggctttatttaggtgagaaaggcgtttgaagaaaaattaaaggtatatagagtgttttaaaagagtaattaacttagatcacctctacagaggcagacagggtttttttttaatagcaggtgaggttgattcaagtgagaaaaaagattactaaagaatgtgcactgtgttagctgggcagcaaaggtttatgtcacaaagttgtcttgaaatagtttgctctgcttctgagtcactgttaactgccagcagtttttcaaatgcccttccagttgtagaaaaccttttagaaggccacagagatatttacatatcatttgcattgcatttgcatctgctcccctcaccttgtagtctggcagcaggcaattttcaaatttttttttccaattgttttccttaatcttgcctcttcccctttccatgccttgaggccttttttccagaatggaatgggaagagtgtgtgaccactagatcacacaggtggaagcagaccagaaggactctgcccaaaaactggtggttcaggccattctgcaacactgatccacacaagacatctattaagacctctcttctgccctcctgccaaaccaggtctttttttttttttactaatcgagttgaggtgctttggcccctgctcccaggagatggaacaagcttcaaggatagcaaaaaaaaaaaaaaaaaaaaacccaccaccaccaccaacaaaaacaggtcttaacctgagcctgagcaaaccagttagttccagtgccagctgcagctgtgtcaattcaagactttctggcttgaaaggtgtagggcaggggctaagcatgccaggctggaagccctttgaggggaaagtagaagttttataccccatcccctccccgcaaatcctagccagcacaggactttgtcctcagtaggtgatccatagaccttgattagattgaattgcgaatttgtgtcatttctctataaataatctctcagtatgtcctgggtttcttcccctccgatgtcatttatattcacattcctctggcaattccctcagttatcgctctaatttagatcctccccacattactgggcacatctttgccacctaataaatagttgaatgaatgaatcaccatatattgggattagtgcaatatactttgagctagaatctcccactcaagccgttccatctacctctaagaaacaaatatttcaaaagacatttttcatcatgttatttccctgctcaacatactgcagtggctccctattactttttctccagtggcttgtcatctcacaaagttatgattcttaaaaatagccgagaaggccccacatgatctagcctcctacactcctactctactccttgctcattcttcttcaaccacactggccatcttcctgttttagttactttcctgtctcaggctgtttgttcttacagttctttctacttggaacactccctctagatatttatagctagatctctgaccttgtataggtgtgtgtgtgtgtgtgtgtgtgtatgtatatatatatatatataatttttttttgagacagagtctcactctgtcacccaggctggagtgcagtggtgcaaccatggctcactgtagcctcgacctcctgggctcaggcgatcctcctacctcagcctcccaagtaggtgacaccacaggcatgtgccaccacacccagctaattttttgtactttttgtagagacagagtttcaccacgttgcctatgctgttctggaactcctgggctcaagtgatctgcccgcctcagtctcctaaagtcctgggatgacagtcatgagccactgtgcctggccttgtataggtctttacttcctcaatgaggcttttcctgactaccctatttaaaattgcaaccccaccctcaacttatccccctttcgtgatttgttttacttaaattgtttatttatgtcttcgctgattagaatgtaagctccataagggtagacatttttggtttcattgatgttcattgccaagactgcctgacacatttttagatgcccagctttgtgtgtgtttgcaaatatcactcaattttagtggtgtcccatttatcaatattttcctttacggtggtagttttggtgtcatgtttaaagaaatcctttcctactgccaaagtttcagtaaatatttgttaaatgaatgaatgaatgaattatagtttcttccaattatttttcatggcttaagctcaaccaataaagcagtgcttcttaaactttaatgtgcttaggaatcacctgcagatcttgtagagctgcaagttcctgggtgatcctgatgttgcggtagagcatgctttgaatagcaaggcaatactgtgctgcataggttttggcattatacctgccacctctattaaggcatactatgagacgccattctatgaagcttgatatgtttatttaaaaggtctatagtttagaatgctgattactatattctacctttcactctaaagacccacaagaggaattgctctcagattgtagagacagtaatagttgtgtgactcctggcaattgattgaatttttaaaatcgtcaaaatatgtcatgtaactgattctatttctcactttgtgttggctactagggagtgtatggctagaattgtggtccatataagctagcgtacagtaccttagcagatctatatttatgtgtggacatttcccctgggtttatctaatttgtttcttccttagtttacccttttctaggttcttttctttttatttgattttgttgtttgtatttatgtttataaggttcagatataagaaaaagatgtatgtgtatgtggcaagagacagagaatccctctctccaggcatgtattttcacttaacttggccttcctggaatagttccaagggtttcttaggcagatatccttgagcaatggggcattgaagtctcaagaaatcatgccataaaaacttatattgggcccattcggctttccactgattggtggaaatgtagcagacaacggcagagggattctggggagacctaggatctcagttaaaataataattctgccactgagtgatcttggaaaaatattttaacatcgttgaggcttaatttcctcacctgtaaattgattaataagagcttcttcgttgacttgttctggttttcattcattcattcagtaaatgtcaggtttctacatggtgtgaggcaacttactagatgcttgggttcagtagtgaaccaaaaataaaagtctgttggtgaagaaaaaaataacatcagtctttttagataagtgctcttagggatgtaatcaggaactaactgaggacaggtggcaaaggggagggctgctgtttggtaggaaagcttctctgtggaggcagcgtcctggcttatcactagagcatgggaaccaagtggctgctctaagaacaggcattccaggcagagggcaagagcccctaaggtaggaaatgacttggacatttcaaagaaatagaaggaggctagcatggctggagcagagagagagcaggggatagaggagtttgaaaccatggaaggagacatgagcagggtaaaatcagatcctggaggcccaagttagtcaaagttaggagtctgcatttgtttcgtgtttaaaggaggaaatatcttgatctgacttaccttttaaaaagatcgccctggttttctgtattaagagtggattgacaatattaagaatgataacaagggggactggttatggggggtctaaaccccttttgtgccaaggactccttgtcagtctggtgaaacctacaggacctcgtcttagaataatatttttaaatgcataaaataaaacacacagaattacaaaggaagtcaattatattgcaaccatgttaccaaaacatttttaaaatgtgtgagcagtagcgtatgtgctcctttatcaacacattaaataagattttacagcaggctaaaggatgatgatacttttgaaacagtgatgagagtcaatgatattttgagataccttccacagctacagtgtggtatgcatctgtgatttctgtaggtgacaaagttacaagtacaactagtggtttgtagtttacatttgtaacgaaatgctaatttgtttaagtaagctaggaaacatgtagatgtgattttatttccccagccaaaggagactggtttggaagttgctgtgatgaccagtcctagataaagtacctagtacagtgcttggcacatagtagctgctaaatggaatcaatggtagcctttttcgctactactaacagaaaacctaaggtaattctgaatatcagatagaaaatgatacttaatatgacgtatctatcttcctgctgtgatttgaaaacaacaacaacaaattattgcaaagttgttaattgggtctttggctcatttctaaggcaggtggttggcagctgtataaggggcaatgcttttagctgtaaataacaaaatgcccaataaaaagtcatctaaataatgagaacatttattacctcacttagcaaggagtggaaaactaggccactccaggattgtttcagcaactcaggagagttatccaaatccaagctctttccaggcgttttctctgctattctcagtgtttgagctgtttcacctttcaatgttgtaagatggctgctgtcattgcaaacatagtgttcccctaactgaagtggtgagggaaggtctgaggctttttttccccctgcatctttttctaaagtcatgtagaacattctatcctggaagaatttccctctgactcattgcccagcacttggtcattagccagttctagtttcagggaggctgggaaggctagtgtttttatttttaaccttgatcattgacaggtaccgacacgaaaaaagggagaaggaaatggttgctggttggttaccaaagcatctgccatttggcgtcccttggcaaggtctgtcttgtgacctcctttatccattcgcttttcatctctttggtgtttcttttcccttttccaggtcacctccatgtgtcatgacacctgtaaggtatcttgtttttgctgtcagctagttgccaattaaataaaagctaagatattaactattaattaagatttaaactagcaaagtttggggaatatattttatggcagcaactgtgtttttcctaccttttcttaaaaattatttctctcatcaaagatataaaacaaaatgagtctttatttattaaaaatttgttttaggccaggcacggtggctcatgcctgtaatcccagcactttgggaggccgaggcgggcagatcacatgagatcaggagttcgagaccagcctggacaacatagtgaaaccctgtctcgactaaaaatacaaaaattagctgggcatggtggtaggtgcctgtaatcctagctactcaggaggctgaggtaggagaatcgcttgaacccgggaggcggaggttgcggtgagccgagattgcaccactacactccagcctgggcggcagagtgagactccatctctaaaaaaaaaaaaaaaaaaaaaaaattattttaaaagttaacatgttttttctttttttagaacagtctattccataaaatacctgtattttatccacttatacaaattatcatattatacatatattacacagcttgctttcttgcttaatgtacattggacatctttgcatattgtatagagagatgtaacatgtaacattctttatactggttccatttaatggttatactataacccttattgatggacatttgggttgattccagtttttctcctttttttgctatcacaaatagtgccataaataatatacatgcatatacatatacagtagtcccaccgtatctgccagggatatgttccaagaccgccagtggatgcctggaaccacggatagtactaaacgctatatatactacttttctgatctgatacctgagacacttactaagtgaccatggggcaggtggtttacagagtagatatgctggaaaaagggatgattcatgccccaggtgggaaggagaatgatgtccccaaattttatcatactactcaaaatggcatgaaatttaaaacttatgaattgtttatttctggaattttcctggtagtatttttggaccccggatgtctgctggtaactgaaaccacagaaagcaaaaccttggataaaagaggactgctgtaaaatgcatatatacatatataatgtatacatgtaatatatatgtgtgtatatgtatatatcttttcatatatgtatttttgcctacttttgcaagtatctatgtagggtaaatttttaaaacacaattgctgggtcaaagtttaccaatattttttatttgatagaggattatcaaattgccctccaaaaatgttctaccaatttctattgtctccatcagcatttgggagtgcctgtgttctcactgggtttcatcagagtttttaatatatgctaaactgacgagtataaaattaggatggaggtttccagggtagaaactgagtccctttattgtttctttcaacttttaccaaacaaaatgcatgtgtaggatttcattcagtctttggatttgagcggttcccatttttaaggcaggtgtgtgtttcatactgtgtaagtaaagcctgaagtttggcttgaaatggcagcagggttgggcaagctggatttttgtaggctgggttcaattcctaattgcctgattacagatctaccaggaagcaggcacttctatgggctatggcttagaccctttgttatgcatgacccagaacccagtgaatgataaaatgcagtgatgtaataaggactaacgatgactgatcacttatttccacacactgttgtaagtttttttcatgtattatgtcacttttcaaaatgtacctaagtgtaattttgtttgttaaaattttttatctttaattcacaatcattatatatatttatggagtataatgtaatgttttgatacatgtgtacattgtggaatgagcaaatcaggctaattaacatatccatcacctggcatacttatcatttctttgtggtgagaacatttaaaatccacttttagcaactttgaagtatagaatacattattattaactatagtcaccttgctgtgcagaagatcatcataacttattcctcctgtgtaactgaaactttgtacccttttaccaacttctcccctttccctccccatttccccccacccacctccagcttctggcaattaccattctactctcaccttctatgagtttgactttttgaggttctacatatatgtcacataatactaccaacaactttataacatgggcaacattattatctccatcatatccagtagggaaactgaggaacagagaggttgagaaacttgttccagatcacacagctagtcagtggcagagatggggttccatcttccccaggctggttgccaaatctgtgatttcaattggtgatcctcatattttaatgtgcatacaaaccccagggatcttgttaaaaatcagcttttagctcagtgagtctggagtgtggctcatgattctgcatctctactgagcttcaggtgatgccgctcttgctggtttatggagcaaacttgagcacaacactctgaattacaatttttttccccaattttatggggttgcctgtcaacaaatgtaactgctcctgcaaacttcatgattttcatcattttttcttgtactgaggatgacttcttccacaggtgcaagaataccagctctctggtttgtgggttatactgaaggaaagaatcacttcctgctgcatctccttgtaggtttaagggatatgttgacatctattgaatgaatgagcaaatgcatggatttctttttcctaatagatgtaatttttcactgtatacagcaagtttttcaaattcctttaaaggcccaaacaaatcacatcccagcaattttaaattatttcatggtaattcaagagacaccttattacatcattcccaaacagaaagcatgagcctgataatcatgataccaagcctattttagagtcattccactgattttacctgtttgacgtaaagtagtgcttctcctccaactctaaatcaatttaaacttaaaatgatcagacatcttcctttttattttctaatcacaatgatttaacagacctactcaaaataatttagaaagctttagatacagtctatttatgtcttttcatctgttaatatacattccacgaaaacccgaacttattatttgtattataatttttttattatactttaagttctagggtacatgtgcacactgtgcaggtttgttacatatgtatatacgtgccatgttggtgtgctgcacccattaactcgtcatttatattaggtatatctcctaatgctatccctcccccgtccccacatcccacaacaggccctggtgtgtgatgttccccttcctgtgtccaagtgttctcattgttcagttcccacctatgagtgagaacatacggtgtttggttttctgtccttgcgatagtttgctgagaatgatggtttccagcttcatccatgtccctacaaaggaaatgaactcatcctttttttatggctgcatagtattccatggtgtatatgtgccacattttcttaatccagtctatcattgatggacatttgggttggttccaagtctttgctattgtgaatagtgcggcaataaacatacgtgtgcatgtgtctttatagtagcatgacttacaatcctctgggtgtatacccggtaatgggatggctggatcaaatggtgtttctagttctagatccctgaggaatcgccacactgtcttccacaatggttgaacttgtttacagtcccaccaacagtgtaaaagtgttcctgtttccccacatgctctccagcacctgttgtttcctgactttttaatgatcgtcattctaactggtgtgagggggtgtctcatcatagttttgatttgcattcctctgatggccagtgatgatgagcattttttcatgtgtcttttggctgcataaatgtcttcttttgagaagtgtctgttcatatccttcacccacttgttgatggggttgtttgtttttttcttgtaaatttgtttgagttcttgtaaatttgtttgagtaaatttggttgagttcttgtagattctggatattagccctttgtcagatgagtagattgcaaaaattttctcttattctgtaggttgcctgttcactctgatggtagtttcttttgctgtgcagaagctcttcagtttaattagatcccatttgtcaattttgacttttgttgccattgcttttggtgttttagacatgaagtccttgcccatgcctatgtcctgaatggtattacctaggttttcttctagggtttttatggttttaggtctaacatttaagtctttaatccatcttgaattaatttttgtataaggtgtaaggaagggatccagtttcacctttctacatatggctagccagttttcccagcactatttgttaaatagggaatcctttccccatttcttgtttttgtcaggtttgtcaaagatcagatggttgtagatgtctggtattatttctgagggctctgttctgttccattgatcgatatctctgttttggtaccagtaccatgctgttttggttactgtagccttgtagtatagtttgaagtcaggtagcgtgatgcctccagctttgtccttttggcttaggattgacttggcaatgtgggctcttttttgattccatatgaactttaaagtagttttttccagttctgtgaagaaagtcattggtagcttgatggggatggcattgaatctataaattaccttgggcagtatagccattttcacgatattgattcttcctatccatgagcatggaatgttcttccatttctttgtatcctcttttatttcattgagcagtggtttgtagttctccttgaagaggtccttcacatcccttgtaagttggactcctaggtattttattctctttgaagcaattgtgaatgggagttcactcatgatttggctctctgtttgtctatcattggtgtagaagaatgcttctgatttttgcacattgattttgtatcctgagactttgctcaagttgcttatcagcttaaagagattttgggctgagacaatggggttttctagatatacaatcatgtcatctgcaagcagggacaatttgacttcctcttttcctaattgaataccttttatttctttctcctgcctgattgccctggccagaacttccaatactgtgttgaataggtgtggtgagagagggcatccctgtcttgtgccagttttcaaagggaatgcttccagtttttgcccattcagtatgatattggctgtgtgtttgtcatagatagctcttattattttgagatacgtcccatcaatacctaatttactgagagtttttaacatgaagggctgtttaattttgtcaaaggtcttttctgcatctgttgagataatcgtgtggtttttgtctttggttctgtttatatgctggattacgtttattgatttgcatatgttgaaccagccttgcatcccagggatgaagcccacttgatcatggtggataagctttttgatgtgctgctggattcggtttgccagcatttttttgaggatttttgcctcgatgttcatcagggatattggtctaaaattctcttttcttgttttgtttttgccaggctttggtgtcaggatgatgctcgcctcataaaatgagttagggaggattccctctttttctattgattggaatagtttcagaaggaatggtaccagctcctccttgtacctctggtagaattcggctgtgaatccatctggtcctggacttttttttgttggtaagctattaattattgcctcaatttcagagcctgttattggtctattcagagattcaacttcttcctggtttattgttgggagggtgtatgtgtcgaggaatttatccatttcttctaggttttcaagtttatttgcgtagaggtgtttatagtattctctgatggtagtttgtatttctgtgggatcggtggtgatatcccctttatcattttttattgtatctatctgattcttctattagtcttgctagcggtctatcaattttgttgatcttttcagctcctggattcattaattttttgaagggttttttgtttctctatctccttcagttctgctctgatcttagttatttcttgccttctgctagtttttgagtgtgtttcctcttgcttctctagttcttttaattgtgatgttagggtgtcaattttagatctttcctgctttctcttgtgggcatttagtcctataaatttccctctacacactgctttaaatgtgtcccagagattctggtatgttgtgtctttgttctcattggtttcagagaacatctttatttctccctcatttcgttatgtacccagtagtcattcaggagcagattgttcagtttccatgtggttgagtggttttgagtgagtttcttaatcctgagttctagtttgattgcactgtggtctgagagacagtttgttataatttctgttcttttacatttgctgaggagtgctttacttccaactatgtggtcaattttggcataggtgtggtatggtgctgaaaagaatgtctattctgttgatttggggtggagagttctgtagatgtctattaggtctgcttggtgcagagctgagttcaattcctgggtatccttgttaactttctgtctcattgatctgtctaatgttgacagtggggtgttaaattctcccattattattgtgtgggagtctaagtgtctttctaggtctctaaggacttgctttatgaatctgggtgctcctgtattgggtgcatatacatttaggatagttagctcttcttgttgaattgatccctttactattatgtaatgcctttctttgtctcttttgatcttcgttggtttaaagtctgttttatcagagactaggaatgcaacccctgcctttttttgttttccatttgcttggtagatctccctccatccctttattttgagcctatgtgtgtctctgcatgtgagatgggtttcctgaatacagcacagtgatgggtcttgactctgtatccaatttgccggtctgtgtctttgaattggagcatttagcccatttacatttaaggttaatattgttatgtgtgaatttgatcctgtcattatgatgttagctgtttattttgctcattagttgatgcagtttcttcctagccttgatggtctttacaatttggcatgtttttacagtggctggtaccggttgttcctttccatgttgagtgcttccttcaggagctcttttagggcaggcctggtggtgacaaaatctctcagcatttgcttgtctgtaaaggattttatttctccttcacttatgaagcttagtttggctggataggaaattctcggttgaaaattcttttctttaagaatgttgaatattggcccccactctcttctggcttgtagagtttctgccgagagatccactgtgagtttgatgggcttccctttgtgggtaacccgacctttttctctggctacccttaacgttttttccttcatttcaactttggtgaatctgaccgttatgtgtcttggagttgctgttcttgaggagtatctttgtgacgttctctgcatttcctgaatttgaatgttggcctgccttgctaggttggggaagttctcctggataatatcctgcagagtgttttccagcttggttccattctccccatcactttcaggtacactaatcagacgtacatttggtcttttcacatagtcccatatttcttggaggctttgttcgtttctttttattcttttttctctaaacttctcttctcgctttattgcattcatttcatcttccatcactgataccctttcttcccgttgatcaaattggctactgaagcttgtgcattcgtcacgtagttctcgtgccatggttttcagctccatcaggtcatttaaggacctctctacactagttgttctagttagccattcatctaatcttctttcaaggttttaaacttctttgcgatgggttcaaacttccccctttagctcggagaagtttgatcgtctgaagccttcttctctcaactcatcaaagtcattctctgtccagctttattccgttgctggtgaggagctgcattcctttggaggaggagaggcgctcgatttttagaattttcaggttttctgctctggtttttccccatctctgtggttttatctacctttggtctttgatgatggtgatgtacagatggggttttggtgtggatgtactttcagtttgttagttttccttctaacagtcaggaccctcagcttcatgtctgttggagtttgctggaggtccactccagacgctatttgcctgggtatcagcagcagaggctgcagaacagcgaatattgctgaacagcaaatgttgctgcctgattgttcctctggaggtttcatctcagaggggtacccggctgtgtgaggtgtcagtctacccctactagggggtgcctcccagttagcctactcaggggtcagggacccacttgaggaggcagtctgtccgttctcagatttcaaattccatgctgggagaaccactactctcttcaaagctgtcagacagggacatttaagtctgcaggggtttctgctgccttttgttcggctatgccctgcccccagtggtggagtctacagaggcaggcaggcctccttgagctgcggtgggctccacccagtttgagcttcctggccactttgtttacctcctcaagccttagcaatggcgggcgcccctcccccagccttgctgctgccgtgcagttcgatctcagactgctgtgctagcaaggatcgaggctccgtgggcgtggggccctccaagccaggcatgggatataatctcctggtgtgccgtttgctaagacccttggaaaagtgcagtattagggtgggagtgacccggttttccaggtgccatctgtcacagctttgcttggctaggaaagggaattccatgaccctttgtgcttcccgggtgaggggatgcctcaccctgctttggctcacacttggtgcactgcaccctctgtcctgcacccactttctgacaagccccagtgaaatggacccagtaccttagttggaaatgcagaaatcacccatcttctgcatctctcacgctgggagctgtagactggagctgttcctatttggccatcttggaaccacatctgtattataattatttaaagagaacatagttcgtagttttttgttacagagtaaatggaaaaataaacacagtaaaacttgttttaaatgaacttaattatttattttgccaataactaaactcagtgctctgtaaggagattgttttaatggaattttattaaatgtattggcctttgaatgtgaaaatgatagattatattaatttcttactaacttcttcactaattacacttttgctggttaatttagtaaatgatgtttgtcatgtgattggctgcaacacaatatacaatggatttcctccaagtgacagggcggtcctgtagtgtccccacatggtaatggtctctaggtaaactggttcaacagttcgtgatgtgtccaagtctttctcttcatgattcaactttacaagttcatctctgaccaccagtcaagtaccatgtcttgactggtttgtctcataaaaaaacaagttgttttcattatacacacacacgcacacagatatatgtatgcatgtgtatataagatacacatgcacacatcactaaactcttcctaattattttctttatggttttagttactagggaaacctaccaagataacaggcccattattcttggggtgctagccacttgatcaaactgaattttcaagaagtatttgatctttctttttgcaagctgaataaaggagtgttttgtgtaagatcagattttcttttctgaatagctttaaccattcaatgaaccaaagaaatgaatgactttggcctgttaaagtgtgagtatggctatctgggtcataaagaagcggtttttcagatgagagacaaagtcttacagacttcattggtaagaacatctaaatgagaggtggcaaaacaaatattggttatggcattatgcgcagttagctgttactgtgcccatctgctggctccattgctttgcatggaatggattccccgtgctcagtggtgtgttgaaatctggtgtctatggcaacaaaagcatcaccaatctcaaagcaagcactgttggtaccagctgaatctccactcacacaacgactttaggaaggagacacagtctgacagactttatggctatctaaggccaaagagatccagtgtctaaccagaaacaatatattgtccttatgcatatatcattaacataatcttgctttttaaaatgttttttttttcttctgagacaaaaagaattgcacatttattacaaattgcaattgttgaaatagtctggactctcaatgaagacattaaagcatgatggttaagaacagccttttcagattcaggtagccttgggattgtcagactccactgcaatatctgattgactttaagcaagttatttagcatctctgaggcttaatttcttcaccaacaaaatgcaattcaagcagcacctacctcataggtgtgctaggaagggccactgagaatgtgtggtaacatgcttggcagaggatgctcccaggcatagactacgaattccctctgtcagccatgattttgagtattggtgggcttcagcatagggtgatgagacagtgtaactgcatttacactgggatggagtactccaccaaatgtcagtatctgtgattcttttttcttgaatctatctgacaactataaaccctccttcaacctactacttggtgaagacagtggctgccagtgttctggatattgattctgagtattggtgtgctttagcgtagggtgctaaagcagtctacattgactaaatagcatatgtattcttttggatgttcagccaatctgtcttatattccctgtggtggcattcagagctgctatgtcctggatggcaacagcaaagctttgagattttcacacagaggccttaaagggctggagggaagccctctgctctgccatgcaggagattaagctgagctgctcaggcagattatatgtcaaagtaaattgagtgggcatcacccctaaaacaagaacttgtgtgaattactctgcacttcctccagggaaaggactcttttctcttttaaaaactgtaggatctttgcagtgttataagaattggctttcttgtctctgatttgtgcttcttggagtaaatcacctgattggcttgaagatactgtaaattgccatataggtgatgttggaatatttgcttcttgctctgttccccactccaaccccctattctgagtggtggattcaataagctattttttgctcttaagttctcgtctttgtttctagagataatttgcttacatagcactaattcagattttcagaggaatttcaatagttgtgacactgtcaaagtgacaacttcaaatgagttttcctcagcaaatgttccaggtcatgtacatttattagcttgtttcagaaaacggttaatacagttaaggattctttcaagtgtttcttcagctactgggctcagaaattatttttttcttgcattaatagactcctctattagtatttgaaagctgtgtgatataaagctatgtgactcactgtcagttttacaaacttaaatctgcacttcactctttcattcctagctcctatttatattcatttatcacataatgcttttgatgttaacaactacactactctaataataaagctataattatgactttcccctatccctaatcggggctgggggtgtcatgtgtattgattagctctgcttatgatcttcagtaccacaccaactgggttctaagtcttggctttaatctccatgtgggtctgttatttttttttctgacacaagagtttcttacacgtgaacatgcattagaatcccttgagggcttgttaaaacacacatcgctgggctccactccctaaatttctggagatgggcctcagaattttcacttttaacaagttcccagtgatactgctactgctgctgctggtctggggaatacatttcgagaacgaatttcttagactgtacccttaaccttggccaaacatctctgaaatgtgggaactaggtgagggcatatggcagcagtaccataaacttatcaccactggaaaataaatcaaaagataagacttactgtgtgacaggcactaagataagcatattttcttcattttacaggtgagacaattgtgacttagagaggtttagtaacttgcctatcatcacacagctagtaaagtagtagaacccacgtttgtctgactatataacttcttaatttctatagatttaagtcaggtaatctgtctgcatgtttttctactaaagcacaaggatcttgggcttgcaccccaagatgtttggaagaatagcctgaactcaactcaacactagaaagattcaggaattagaggttctaggcatctctggtgttagtggtggtgtgggtcatgtatgaaaacagaattagttgcaagtttgataaacagtggttagactcccagatactttcccaaatctgagcaaccagatgatggtcttaggccagatttcccaaagatgaccgtgagatgtggattaatatggaattgttgattaaggaagtgttccaaggagaaaccagtataagaatggggaaagtaggaagcagtgaatggaaggaaatgaagcaagagtgtgatcttaggctaaattccagcctctgtctcatcttgtagggaagctctagagtgtatattacactctaggctagaggtacactgttgtaccagtaatgagctccagctggtggtggggggggtatgtacattttcaggtactacagactctcttggcatgctgctgaagttgtacttgtagcccaaagtagggctctaaagaagcctgcaggtgagagttgttagaagcaaagcatatggacatagggggatggactcaaagagctgataaagaagcatctgagaaggtttgatagggaaacctgcagttcctccacctgggccctccacaccttagtagaagccctgagattcacttttttgacagattgaattaaagaaactcagctttgaggcccaaggcacagtccagggcacagtcagtggtacttcactgaaagcagaatgacctgaaagtttacatgctgaattgtgggcgcctccctcctgcacacacatttagttaacctcttcctgaaatccacatccagaacattggcagccactgcctccaacaagcagtaggttgaaggacgatatgtggttatcagatacattcacaaaaaaagaaccacagatacagacatttggaggagtacttcatcccagtgtaaatgcaggtacactgtctcatcacgctgtgctaaagcccgccaactggctagccctttcccatacccagaattgccagtgaactttttaggatgaaactgttaaataggaacggtcattcaaaagacatttgaggaacatgtctgatttaaaaggcagtgatggtaacaaaatatacaaataggaaaacaatcttggaggaaacagataatactgcataagaaaatttcccaaatgcccaaatctataattaatattgtcagagaagaaagtaatcacatgtctgaaatgaaagcaggatattattgaaaggactgttgagagaacagaaaagaactcttagaaataaaaaaaagatagcagaaataaaaataattcagtgcaaaaattagaatattaagttgaataaatgtccctgaaagttcagccaaaagacaatgagattgataataagagaaaagattaattagaaatgtctaacctctgtctagtggtcggtcccaattaaaagaacaaagtgaaagaggaaaattatgaaaaaaagcaagaatattttttataagtgaaatacatgagttgccagatttaagagacccaccagcatattggatgggaaaacaataaagaagagtctctaaaaatttccaaaaaggaagaaacctggtttcatacaaggattagcattggacttttcatagcaatttagaaatttaaaagacaatgaagcaaggtctccaaaattcatagagaaaattcttaactagaattctatagcagccaaaattatcaatcaagtgtgaaagtagaaaacatatctttagctatgcaaggtctccaaaaagataccctttttgtagtttgtcaaaaagagggaatgaaccaaaacattggaaaatatgggatcacaaaacctgaggccccaataccagtggggccacagggaacttccagggtggtcttaaaaggacagtccaggatcacggctgagtattaataccaaagggagaaaaaggagacaaaagtaggactaattgcacatgatattgctcaatgaatattgatttagccaaataatgtgatactattattttgggtaggtaagaaaggagaagtatgtatggagagatcataaaaaagctaaagtttcatattccatgttaacagattaatatataatgcctaaatgaacaaataaagaaatagttgtataaggatgtcatttttaaaatatggagataagttgctaaaaaaatacacagataaaagtgttttaattttttgcctcaaaggagttgatatatggctgggaataggtgggggcaggagtctgctattattttgaagagctcttgacttttaaaacaatgaacatgtatttctttgagaaatataaacatcaagaaaataaatgagggctccttagctgactttacctgtgctttttggccattatttatacacagtttgttttgttcttcacatttacccccttcctgctcaatgattaaacagcgttgttggagaacatttatggaatgccatctaataacagaaatgatgtggtcatttatagataaattttgtcagcaaacatttccccatcaaaaatatagcttaatatatccattatatccttataagccatagtaaattaagatttaatgatgatgttttattagtagaataaagagttgaatagctctgtgttgattcaaatcttcctatggctttatttacacagttgtgccttccgtagtaaagtattgagttaaaaatgagtactggacctatattaagcttctacccagtgagaaggggtatggggatagggcccagttaaaataatgaaaagtgaaaagatagatgattagaatacaataactggttgaaccatttatctaaagcagagcaagaataacagtttttcatggcagtgactctaagatactccaagtttttaaaatgctttcaagtcattgcaaccaagataaactgataattatatagaacactaagttgctaagtgctttttacataagctgtcctatttaattcttgcaatatctcctcaagttggatattattaccacattcattttcagaatagaaaatagaaaacattgcagagaggttaagtagctttccaaaggttatatggttgagaagtaggataatgataacatttattgcccaagcaggatacttttgacaggcatcaaccagtggggaatctaacaacagatacaacccaagatttacctatgggacttatggcccccaattgataagagatggagcctagtccagaactcaaattcttctccaaagttgtgaactttctgctgccttgggctggtagtatcattaatgttaaacgaaattccccattagctaattataccaataaatgttgactgaatggcaattgtttttgtttgttgagagaactttcatgggaatgggcaaagcttctaaaccagtcttggggattcaggactgaattagttgcttactctcaccctagactcaccaaagtagattgaaatcttgtagagggaaggtgtctgggggtcattcaagtacaggttagaagtcctgaatagaacataataaaaggactggtagtgcaatgctggagacaagcatgtatggttaagtacgtggagcgaaattagatggcaagttgtgcaataaaccacaaagcaaaaagtttctaacaaatttgttccctgagtttcttctgctatttttctcacaagccatttttataatgttcttgctcccttttccctggcatttctggctgcccttttgggtgtattgctcactggacgtacagaatcacttttgttttcatcttacatgtttcctagggagccttcagctgaggcaactccaagctcttaattgccactgcctttttactactacagagcagaatgataggcaccttcctggcaaacagaatatgctcaatacatatttgcagaaggaaggaaggaatacagatgacgtgtttttaattttatgaaaccaaataaccccctttgaggctcaagtataaaaatctaaagaaatggcaacctacattttaaaactagctgtttacatgctcctgcttaaatgtgttttcacttttatgggtctgacagcagagccacttaggattaagtatttgatggacaggattcttagttggtcatgaatattgtcacattttcacatacaatctgccttttgacagccaaaagatggcaaaattctaccacttgtatattataaaatgggaagtatccctagcttgtgacagatccaaatgatccacttacgcgtttctgtgctgacaagtagaactctctgattgtaaacatcttttaggaaactgtaattttgtcctagtacaatacctgacatctaaaaaggcttttgtttggcttttaaaaataatcatcattacttttatattcatgcaggtgataaaatttcatatatatttctggacccttatctccttatgtttaaagcttgcattcactcttgataaattgaacattgactagctatgcactttacagctattagaatttctctttttgtctgtttcttttgaagggcttgcacttttcctgtaaagaagaatggagagtaatatagaaaattgtcactttaattttatattaatgtgttgttccccaaatagctgttaaattcaatgttcatgaattatatatgtatggaagagtcaaagcttatttccagtaagtttacttttaccacagctaagaaatgaatatctaatcatatccttctcctagtgaataaagacacctgaagaaataattacatcagaagttggaaggaaaaatgggtcctcgtaatttttctgaagcatactatgacttaatataatatttctccatcttagatagcatgagcttttaattagcaaggtggcaccctgtatggaacaactgtttctgagttgtgctgttgataattgaacaaagataactccctatcagtatctccagcagtcagagaaaaatctccaattcttccctttagcgcaagtgacttcttagaggttctactaaaattgttgtgtcaaatggcttttaacattttgcttttgagcttaagggattttatgtttttcatcaggcaagctgtgttcctgtcctgatgaaccaaatgcgaatcaaaggcagaacaatcttattgtgatttctgttactgtgtagcgttttttaaaagagatttcaggccaaaggtagtactttctcagaattctgaagctgtgttctctggcagttacgattctgtcatactttcagtatgttcacagtgtcttctgatttttgattgccaggaattcctttgtcttttgctttcttaagtttcatttggtgtgtcttgtgtatatttcatttaaaatatcctacttgttatatgttgtgcttcttgtagttgtggattcacatctttagtgacttctagaaaattcacagctgttgtcccttcaaatattgcctcttctccatttaacagctacattgagatataacttatatatcatacaattcacccgtttaaaatatacagttcaatggttttaatatgttcatggggttgtacaaccattaccacagtcaattttagattttccttacctcaaaaagaaaccttgaagccattaacagtcactcctctattcctctcaaccccatcccacactcctgctgacctaggtacccctaatttagtttttttctctatggattcgcctattctgggcatttaatacaaatggaataatataatatatggtctttggtgactggcttctttcactaagcaaaatgtctttaaggtctatgcatattgtagcatgtattagtactccattcctttttattgccaaataatattcctttgtatgaatgcatcatattttacccatttgtcagttaatggacattggagttatttccagttattggctgttatgaataatgctgccataatgctgttttgaataatcctgatcatttgtgtacaggtttttatgtggacataagtttttatttctgttgggtatataactaggaatggaattgctggatcatagggcaactgtacatttagcattttcaaaaactgttagagtgttttctacagcagctgcaccattttacatccccaccagcaaggcacgaagggttcagtttctccataccctcaccaacagttaattatttgtttagagacaaggtctgcctctgtcaccaaggctgggggtgcagtggggtgatcatagctcactgcgagtttgaactcctgggcccaagtgacccttccacctcagtctccctagtagctggaactacaggcacacgccaccttttttttttttttttttttttttttttgtagaggcagggttctcgctatattgcccaagctgttctcgaacttctgggctcaagccatctttcagcctcagccttccaaagagctgggattacaggtgtgagctgccaagcctggccacagcacttattattatcagacattttaattatagttatgttcattgggtatgaagtgtggtatctgataatcattttgatatgcagtttcctgatgacgaatgatattgaccatcttttcatgtgcttattggccatttgcacatctttggagaaatgtctactcagatactttgtccatttttaattgagctattattatttttatttagttgtaagagttctttatatattctggatatgagtcccttatcagaaatatgatttgcaaatattttctgccaacctacaaaagtaggttgtcttttaactgtgttgatggtttcctctgaagcacaagttcttaatttttataaagtccagtttatcaactttatcttttgttgctcatatttttggtatcatatctaagaagactttgtctaaattgaattcatgatcttctccattgtttgtatcaatgctttgctaccttggctgcccattaggatcacctggggagttttaaaaattcctgagtccaggccatgctccagacaaattaaatctgaatctcctgggccaggtcctaggcatcaataattttaaagttcttcaggtaattccagtgtgcaaccgaggtagagcactctgatatgcagtatctagtcaattatagtaatctgtcttttgtaagatgcatttttatgtaccagtaagaaagagaaaaatcactgtcaatcaaaatgacacaacaccttcttatcacttaggattttatacttattgaaggacaagtataacttatcttttaaagttatttagacattgattttatcatgtatcactcatgtgtatacctaacagaaaaatataagcaagatacgttcattaagatattcataaaactttcttacagtcggacttctacagtcctgaatcacttcttcctcagtcactgatttccgtgatttttcacaaagtaccttcctttgtaccatcaaaagcagtagtgatgcagaatttcttaaaagagtgttccactttgtctgtggcattttttcccaagtagttgacacctagtttgaaggttttgatgcacatgcacagaccacgagagtcacgtcctactgcctcctggccgatggtgattttgacatatattccaatttcaaagatgttaagatttttttaaaaaagtatatcttggaattgataaaattatgtagtttttttataataggaaaagggacttcgaagtatctagactagtgctactcaaagtatggcttgcaggtcagtgccattctgcaaatttgttactagtctacacgatgtaagtatagaaatttgaggtaagcacttaggaactttatgaacaattagactgagtaattagagtgagttttctccggtaatttctctggtgatgtatcagtatgttattttgtgaaaatatcagtccattatggattagacatttaaataaaaacaagactatttcttcaccaatgatagtttgaatactattgatcctagtggttctgaaattttagtgttcatcagagtcacttgacccagactgataaagcacaagttgttagccttacatagatctggggtagggtgggataatttgcatttctaacaagttgctaggtgatgccagtgctgctgatccaagtaccacactttgagaaccactgtcctagaccactataatgctggcagcagaaattttgccaacggtttccagcttaatttgtagaacacaaagtcctgatgctctcttggaaagtttcagcttccagtgatcactcttagtgaagttagaataacttctttaaaactcagtttaatctcctctccttggtgcactgttcagagcaccacaacatacagtggcataatcactgtaggctgcagagtatatgtgatcatgtttggttagatgttcacagtcttcttagaagagcaaaacatgaattttatttttcaagtgaattggtgctatgatgggtataattaagctcccagttctgagaattctgtgggcactctgttgacagcattctagagactggctgctcaagtagcacaaatatccaaggtaaccctttccagtggcataaaccaggcagcctgccagacttctgagatatttgtattggctcatcgaggtgacaggaagaagtttgtttataaaaaatcggcattgtgtatccatgacatgcttcccagaaacaaatattgttatcattgtcatcttaaagaataaagtagcccccccttatcctcagtttcactttctgtggtttcaggtgcctttggtcaaccacagtctgaaaataggtgagtatagtacaataagatattgagagagagagggagaccacattcacataacttttattacagtatattattttaattgttctattttattattagttatttttgttaatctcatactatgacaaatttataaattaaactttattgtaggtagttatgcataggaaaaataacagtatacatggggttcggtagtacttgaggtttcaggcatccactggggatcttagaatgtatcccctatggataaggatggactagaatatatatcaacctcagagaccttaataaatgacccattagggaaaaattaatatcattggatgagtcaaatatattaattattggtgccacaggcagagtaaccttccttcttgccaccatggcaaatgctgctaatcttttcagtgtccacaggcaacatctgtagccctctgaatattagatgatgcatgcctttcactgggatgggaataattaacaccctggtattgtaacctgctatgaaccttattagagtactaattcagtacttctcaaactttcatgcacctgaatcacttggagaacttgttagggggctgggatggggcctgagattctgcatttcttttaagctcctagttgatatctgtgttcctggtctgaggaccaagtgttaagtgacaggatgcgaaacacttttgaacccctgcttttgtaaggtcgcctgtctgacaaactagcaagtgggacagtggtataaccctttaccagaagcttagcccactcacccaaagtggtcattgcctgtgtctctactcagtaaaaacattcagctgacactagggatactattcgtgttggaaaccactccttttatgtctatatactttaagatatttttaccttgggcatgaaaaatgtcaaatttatttccatcagaaaatgctgtttggtgggggaagagttgtcatgagtagcatattgtgggtaattgcatagcataatatcagagaaaagcccccaaatactaaggaaagataaaagatgcagcctctgtgatatgccacttaatgatgtcctcagaaagccacagctttcccttgtaaatttcaacttatgatcaatgatcagttgtgcatgggatgagtactgctttaataaaatgataatttcattgcttcctttggtcttgggtgaaactcgagtgacgagatattattgagtctgtgtgcagtcatggctcattgtggatacttagcatgcttctattctcaaggagcacattacagtaaactaacaagaattattttaaataatgaaatctacccagatctgagggcaaatgctagattcctttcctggataaatgtcagttagcaatgcttttagctgcaaatgatagaaaatatgacttacagtgccttaaaatagggttatttttctaatacataaaaaagtctggaagttggtggctgctagcaaatgagttcaatgagttggtgatgtcaaggccagtgtctctggacttcattgccttttttgccttatggttgcagataatgtgtggaagctccagataccatgtctatgttcaaggcaggaagaagagtgaagtctgtaccagatatgtctgaacttatcagggaaacgaaagctatccaataaatctccagcaaatttctttttatgtctattgagcagaactgttacatggccatgtaagggaatctggaaagcttgcatttatctggcctaccttgaaaaatattggggtcctattagcaagaaagaagggagagattgctactgggtaggcaacaaactggtgccatgccaaaagtagctagaagtaaaatttccccgcctgatgtgattaaacttcgttcttagcagaatgcaatgatcatttctaggaaaaagagtgagtgtattggggcaggttgggagttttggtagagagaagaagcaaaggtcaaacagtattttgacatccaaactccactccctcccagtgagaaattatacatatatatatagttttgaagtaacaaactatacctgaattcaaaaggaaaggcaaacagacatcatgttatgcatgcaaagcagtttgcaaattcaacaacagaatttctaaagtcataattatggcagctccccttattctgcagtctttttagaaagttcaagtattaaacagcttgtgttgtcagcttaatgaatctctaatgattttgaaagaaaactctgtaccattaattatcattagaatgcctcttgggacacttcaagattccatttttgataagaagcaacccataaggtcttttcctaaagaatgaagcagcgtaaaacatgaacatcttggggtatagttctttaaaaaattttctttagacattgattatttgaataataaatatttctctaatgatgttagtatatatttgtttttgattttttagtcaatgttctgcatgagctaaagttaattagatttgattggagtaggattttatacatagatgagcctgggtaactgtttttgtcccctttttcatttaatcttattaaaataatttaatcactaggaggtaactcttcttttgaaattgaggaaaaatgcaattttggttggaggggtgattttttttctcttaattaaaaacagcatgtacagtcaaaatcagtcttttcaacttggttttgtaacattttgaaggtgattgccttgtttaatcctttctctgtgctttctgtttctgaattagctcatacagtttttatctgtagtctagtcaccggataaaaaggaatgatttctgtgttgtgtagattttagaatttggggagaaaagtgagataaaagacaaactttaatttagtttcactgatctaaaggaaatagaagtgttttacagattcctataggaagtctggcagggaatgtcaattgtgaaaagatataggtgggccattttcgatagatcttgaatcaagagattagttcttactagagaatcactttcctgcttccaaaagaaaatgtgaaataacttgtgccaggatctaaaagatgagcagggtcctagtgggacaatgtggtagagatatcagaaactagattttccaggagttttatgcatgcctcagagtgaatgagctgaattgacagactaggggagatgtgaacattgaagtggagtgctgtattctaacttcccattggttccactgcccctttgttgacatatttgtaagtactactccctcttttgtgtctgtacagaagttggcactttgggtcctgagcactgccagtgctgagagttctttgagagcagacccgaaacctcaaacccgaaagggtaaggagtatatcccgtcttgttttccaccatacttggtgttcaatgaattgatgaatgaatgaagaaccccactgtggttcttagacttgtgtttgtatctcattttaagatctacattctcattggcaaatcatgcctacattccactgtactttagtcaacttgtattgagagactacttggtgtgactttgaaaaattattgaaatatcttgaacttttcttttcagagcacaatgattagtggggataccttgtgcagaagaaaagggaaaaaaggtggcggggatagggaaaaagaaagaagtgttgaagttgataggcatgagcacattcaggtttaaattaactttacaagttgctgcttaagaaatatacctaaaaaatgggcagctctgctattattgggagacgaaaatattatctcacctctacaaaatgaggctgcaatattgaaacaatgccagcttccctgctgggcagcctgccgacatttcacttaggcactgaattctttctcagctactctggcatctgtgcccttcctgctgttccccactttgccaaaggctcagcctccctgagccatgtgagaatctgccctttgttgtacttgagcagagaatgttcccaacatttcatttgctcttctcctggtgagctggagaggaagagagaagcagtgtgacaactgttgtactctcaagccaaaatgtcagagctgttctgaagctaagcaccccatctttgaagtcattggcctccctccaagtctttctggctttgaaatggcagtcagatctgcatttgtcctatgaggtgctgtaagaggttctgcagtggttttagatttggagctcttgttatgagtcatctggagaactttttcagagatattccaccttgggcacatgtgtcagttattactggtgcgtaacaaacgacctcaaaactgagtggcttaggttttgttttattattattgttcgtatgtctataggtcacctgatagttctgctgagctgggtcaggcttggcttatttgggttgggtttgcacatgtgtctgcagttaggtgaaaagtcagctaacactggctggcctggcacaggctcacttatacgtttttcagctagccagctattgactggtgtgacaggggtggctcaaaatcaagagcagggatggaagcatgcaaagcctcttaagtttggaagtgttgcaccgtcacttctgcagcatttggttgaacaaagcaagtcatgcagccagttcgaacaaagcaagtcatgtagccagttcagttgtgaagggtagacaactggattccactttttgatggaaggagctacaaagtaaaatagcaaaagtcattgatgcagagagggaaagactttgtggcaggctttgcaatttttcacagcatgtggtctcagaggcagcatgaaatgagagatgcattgagatgtgtggatgtgtgttcttggtttctacatttctgtgaagtgtgagatgtgtgtgctggagaaggggaggggcagatgctgaggagtatttcacacccctctatcccctttgtcgccatcatctttcattagggctgccacaaataatcccagacagctttcttcacaggtatcatgggccatttatccttacgcctccgaagggccaatgttaggtattaaactgcagattgaggccacagtggatgtggtattattcagttatgtgcttttgctatttgttgttcttttgaaaagcaaaaaaaagatgggatagtgattatgcaaccccattattaagctattatattgttgcttttgatgtagttcccaccttaagactgaaatacaatgactcaacttctgagatttccttcttagaccaatgcaagtatacagcccacttaacaacaatgaaggtcagtggtgcacatcttcggtatattcatctcatccctgactccattttagttatcctactcttattttgatttcttattatcctcatgatggcctacaggaccctaaaagatgagcaacagcccttcctggcattacctccctgacctcatgtcctacctgtgtcccctaggcttctactgcttcatacacacaggcctccttactgttcctgaaacacaggtacactccccacttagggcctttgcatgagctgtgccctctgcctagaaagcatcacctggctgacatgctcacctccttcaggtattcaatacaatgacacctttttgacgagacctacatggaccctcttatttaatacaacacactgccacgctctcaccaaaacatctcagtcctcctcccctgctctgcattttctttttttctgaacactgatcaccttctagtatactagacagcttgttcatttataatataaattttgtattgtctgaacctcctcttcctgtgttttggagatccccaagaccaccccaggatcagtgagtcactgggagaactcaaaggactcatatggttatagccacagttatggtttattacagtggaagaacacaaagcaatatcagcaaagggagaattgaatggattgaaatactggggaaaccagcgcaggcttccaagggtcctctcccagtggactcacataggatgcacttaattcccctaccaatgggttataacaatatacatgaaatgttgtctaccagagcattctattagagactcagtatccaaggtttttattggggggtggtaacataggcaccccctgcccaaaacatatcaaaattccagactcccagaaggaaattaggtgttcagcataagtcacattgtttgcacaatttagatgcagtgagccagtcttaccagtcctgggaatggtcgtcccaaaattcaagttcccaaatgccagccaaggaccaaccttgcaagcaggcctttttaagaatagcattcccagtgctgctatgttaacacatttctctacaccatgcaggaatatcagctctttgaggacagaaatcttttgttttgttccatgatgcatcccctaaaaccagtgcctggtaggtgtgcagtaagtatttgttgaatgaatagatggaacccagacccttgagttaactgtctctatagcagaaataccacacaaaggaggaacaaactcctgatttacccccacgaggctttacctgaaccagcagtcccacgtacgtgtactcctacccagatgtctccgtgtccaaggagcctgaaacgagctcagcttccacgccctaatctgatcctgattatttcacatgtaagtctatctattcaacagtgtttcaaacacttttgatggaattatgcagcatacaagctggaaaaaattcttctcccttaagagcccatttgcttagatgcaacatgttcagaataacctagttagttgcttagtgagggtctagtcctcttcatctattttttgtcttcaccacatttgtcttttgccatccacagtgcctagcactgtgctaaataaatgcaacattgcctttaaacatttctttggactgaaaactggcttggggggatcatttgactttaccagtggctggttttgacatttatgtcagcaatttcgcagtttcttcttctaatgtttatttttaaaggcaaaagtgccaagttaaatgattcccctctcccataacatacatttccttcttctctttctacttcctgaaccatttttcattgtggctatgtaagctcttccatttacctagtatcagtgactctttaggtaaaaatctcatttttcattctctgtgccatcagtaatagaaggattaagctaatttcaaagctacttgtgtcaggatttcatccaatctggaaagtctatctgtgtcatcacaggtttgcgtgtcacattctgaagtttgacaaattgatggaatgaatcatttgttgaaattcaacaaagagcacccagcccgtgttctattctctgcttaagattaatctcagctcaatattactgaattgaatttatcagcagataaaaagaaatattttcaaaacaaatatcatagtaccagcttagaatataaatctttcataacatttgtcatcaaaattgttttaatattattgcaagaatgtgttgaaatattcctaccaatagaatatgctaggttggcatcttaataacaactctaatgctgagtcattttgtatagggagaatatttttatgaatggaagaggaattatgaatctattcttaggtcaaataaaaaataattgcacatcaaaattcctgggctgatcagatgaattaagtttctggctagctgagaaatgacaaattctgagggagataaactgtcagggtgcatttaccagcaactttaacaaatgatttggtcttgacagaaatgttttaaatacagcttctagctgtttaaggtatttagtcattttgacaagactgggttagccattcctgaaactttaaaaaatctgacatgaaaaaaatggaaccatatgccaagatattacagtacttagctagtgcttcggggggcagtgactttgttgcttcctagaactagtaaaagccttaaacaatttgtttcccaggtccttcattttatagatgagaaaaccaaagtccagagagaggggcatacagtaaactaatagcagaacacagaacagaactcaggtcttttggctttcaagtcactgtatcattgtaattcaattttatgttttaaggcagtggttctcacaatgcagcaggcatcagaatcacctggagggcttgctaatacacagattgctgggccctacctcagagtttctgtttccatgggtctgggatagagccagagaatttacatttctatcaagttcgcaaggaatagtgatggtgtggctccagtgatcacactgagaaccactggtcaaagggataggagggataggcgggaaaataagaataaatgtggaatttcctgcagaaggggaaatctttgattggagcaagtattttactaagtattagtaatcagggaatggaagggtctgttagtaagtttacttttcctattgcccttgtaattattactagataaggtttttactgttggcacaaatgcctcaggaatttcttgcctggctcagaattatgacccactggggacaatgattaattgtaaatacttcttgagaatccaaatcctcactaaaaattatcaaattgcctttactcatcttgaatattcacattaacataggaaaaaagagaaccagaaatgatgactgaaaatgaacaaaatgggtaattgagttgacaaagagaattaaacttaaaacaagaatttgattccctccgattttgtttgtctgggccagttaacaaatttattgtcagaaatgtgctttaagttttccttggtgctacagaatgggaagatttcctgatactaagattaagtctaaaaaacaaattcccactgagagtctaagcacatattttcattaacatacagtttatttccacttattttctgtttttatcttttggtcagtattcatcagctagttacattcaagtagatgctttacaatatattgagacaaaatttttaggtaaattggtgataacagccttccttcctgaagtctcctttcagcaaccttccacctgctaaaaagaaatccatatttgcctacttagatgccgtctttattgtacctttcatcctcctagagaaggaaaaaatattccttgttgatctggaggctaaactaaggttttgggagaaggggagaataaaacttaaatggcttctggagcttgagaaagcactgatgtgtaaaaggtcctgaagcagctatgagggacaaaggaggtggagaatcgggaaagggtatgaggaagtgttattgtggattaagaatggatttctgttattgtactttgaaagccaagtaaagaaagagctgctttttaattatctgtagatgctaaaagagatactgcactgagattggaccacatgggtccttgaatttattaagtttacccaaagtacctaagactcaatctctgctctaataacatttgtttcttagggggaatcaaggaaatccatggaaaattaagtttccaagaaaaccagagtggatgggataaaaaaaaacccctatatgtatagtgacacactatacatatctataaattaataaatatttacagtcacatgaaagctcttgcagttggtgagatgtgaagctttccctattgctacagcagacttagaaaagagataggggcatgcagattgaggggagaacctgagagtacaggcttcaaaaagtggaaaatatactgtgactttaaaaaatattgttttggtaaaaccctgagtcagctttccattattgggaaaccaagaggtatcagttatctactgctgcctaacaaaccacctaaaaacttagtagttcaaaataatggcaatcatttattttgctagaaaatatgcaatttggatgggatttggcaggacagtttgtctctgctccttctgttgttagccgaggggctcaacttggggctagaggaaccattttcaagatgctcattcacatgggtggcaagttggtactggctgtctgctgggaattcatctggggttagaagccttggttcttccctgtattggcctttccatgaactgattgggctttttcattgcgtggttgctgaattaagtgagcatcctaagagaatatagcaaaagtgcatgacatttcatgacctagccttggatatcataaaatgtcagataatcacacagcaatcacagtggccattgaggctcaatgggaaagagagtggcaaggtgctacaaaaacatgtggatgggcttttgtagccatttttggataatacagtctgccacaaaggggaccctaaggtatgttctatgttttcaattagtatttacaacagccaaagagatggctcagtgtttctcatcttgctcctttttctccctctgtgcccgtagatagaatgcttggcccttactacaaggccagtcccagatgcaaccctgcttttccccccatctttgttcctgaggccaattttggccacttataaacacttcaggtcacagagctgagaaggagacagtcaaaaaagaattaaataagagaagcagaagttgcaaatatttatcagtggcctttctaaccaacagtggccctccctgacacactgagagattcaccaagattagaacttcacctatagtagccaccacatttattatactgtatatagtccttattttagtttgggttcccccaaagtacatcccgagacaaggatttgggagtaagtagtttatttgacaggtgatcccaggaaacatagtgagggagtgcaaagtgagattgggcagggaggaaagccaataaaatgtgtgataataagcaggttatccccatgaacaactagggctcgagcccatggagactcttgatggatggtgtagaacacatccagagttgtcccctagaaggaattaggaaagtagagtatttatacacaaatccctgtccctcattggttgggggcatttgctctgacacttgcagcttgtcctattccagcccaaacacgctcatgaagccaaacaaaggctttaggcagattgaacaaatctttccattatctttcatatgatgcttctgggcagaccaaaacagaaagcagagtgctgattagccttctctcctcttctcctccaatgggtgtccttataccttggccatctcctctgctccgtggctgtggtgggttttttttgatcctccatcccaagctatgatttgaggtacctttgctcctttattatactccatccttgccacgaatgtaggcatagtcatcctgtcattttaaacaaggaggatagggcctgtggtccccttctggtgtggaaagtgtaaaggttccctgaatggctagggtcaaggtagcaaccagtagttatagaaaaaggatacataagggaaaggaaaggactgatatagaccagtgtttttaaagtgaagctcccaggccgccagcataactggactgcttgatgtaaatctacaccaagaagcaacatactgaggagcttcagagcataggcgttggagccagagtgccagagtttgaatctctgagctacttactagttgcatgaccttgggaaattacctgagccttctgtgcctcattttccttatctgtaaaatgcacctaggtcatatgactgttttgtggattaggtgacatagaatgtgaaatgaatgtatactgcctggcagtttctaataatgtaccttttattttattttattttattttattattttattttattttattttttgagttggagtttcgctctcgtctcccagtggtgcgatcgtacagtggcacgatctcggctcactgcaagctccgcctcccggattcaagcaattctcctgcctcagcctcccgagtagctgggactacgggcatgggccatgagtcctggctaattttttgtatttttagtagagacggggtttcaccatgttgggcaggctggtctcgaactcctgacctcaggtgatccgcccaccttggcctcccaaagtgctgggattacaggcgtaagctacaatgcctggcctattgtttttattattatttctagttcatatcctacacatagtgaatcataatctatgagaatggaacctggaaatctgcatttctaaccccccttccccatgtgatttatatgtatcctgaagtttgaacaccagtgcttcaagctgagagcccaggagagagatcaggtgatgtcaagacaggattgtttaacatagtaacatctcatttccccagcaactttgggaaattaggagtttcttataagtgagttctccagatggctgagactgttctctttaaacactcaatctcaaaagttaacacttgatgtattatgcttaactgtaaacgatatatcacatgcttacacagagaattctggaaagtagtattataacaatatttttggagtgacttagttatcatcagacagccaggcagatggtaagtatttattgactgtctcactctgtcccctcgttttggtaggtgctgaagatacaaagatgaacaggaccaaatccctgctttcaagagtttcactgtctagtagaaaagagatcaggaaatgttgacacagtgagagaagtgatagaatagaaggctgttttgagctttattacagggaattcctaacagctataaaagtgggaaggatatgttaccctgatgttgagccccctgagtgcttgggcctgctatcttatagctactatgtctctcccttgctgtcaattgacactccctgtttctatcaatttttctgccttcaaaggacattcccatcctcatctactgtgcttcctttattctgctgtggtctggaaaccagataccctgaacttgatgagaggttgccgtcttagaaaggccttctctgaccttgctatctaaagtagcatgccccaactccacacacaaactctgcatctccttaccctgcttgatttttctttatggcctttagtactacctgacatcatgttacatatgtttgtttatgttccatggtctactttcttcattggaatgtaagtgtcaaggaggcaggggctctgttgtttagcacacctcagtatctagcacctaggacatggcctggctcagggttggcttctaataaatatttattggatgagttataatagtagcaaataagtttctttttaaattttttattgaggtatagcttgcatatagtaaagtgcacccatcttaagtattcaactcaataaatattggttaaatgtgcatactttataaaccacactcagacaaagatatgcagcatttccagcacctaaccagcaggctccttcaaacaatgcccatacaggacctcctccaaaagataactactcttgtgacttctatcataattgattagttttggtgatttttgaatttcatataaatgggatcatgtagtttgtgctcttgtatgttagccttttcaacattatgtctgtgttgtgtgaagcagcagttcatgccttattgcttgtaatattcattgcatttactgcagtatgtttagtccattctactcacatgtgtgttgtttctaggttttggtgttttagaaaatgagctttgagaaagtccgtgaaaggtgccatgagtagagggcatggattcgatagcaactattctgtgtgcttttcctcattaccccattttatcagtcctacatttctcgaactgtcccctttcttcctgctacttcagggttctgatttatgcttggacctgggatgtctctctggaactaagtcaaatttacaaaacccctagttggactagtgttgtagtaaacccacattcctgccagttcatcccaggacacccaggacacagaagcagaatgctgattagctttctctttggatatcctctcttttacttcctcttttgtccttggttcttgtttgctttctgctaattccctccactaactgggggcacctttgggcctaatgtgttttatagccatgattctcaatcatggctgcacattataatcacttggggaacgtaaaaaaaatacccatgcctgggccccactccaaggcaattaaatcaacatctctgggggtgggacctgggtattagtatttctgaaaaactgttcaagagattttaatgggcagccaaatttgagcaccactgcgggacacattttgttttaggaaatagtgcagatgtgtagaatcaactcacttctttcccccggcatcaggcacaaccaatttgtttccacacaacttaccagatgagactcttgaatgttgtcaactttataaatcttagggagcgatttatatgagaactgcttaaaaacaaggatgtcaaaggaagcggctttttcttctaccatggttgtcactctatggtgtcaagagaagtgttagttgaaatttggctcatgaattacaatttagatcaaactccaagctgtggcagggatgtcttgactagcattgagtggatacttctgaaagacttgtgatttttaaaaacatgtgtaccacatataagcacaattagcactactaggttacaagtgtaataaggccagggtccattttataataatctttttcctgacaacattcaacaccattttgtgtactgcaactaacatttactgagtactttctgttatttactactcagcatttacaactcaatcctcactattataccagctgtcttactgagcacttatgtgttatgccctgttctaagctctttaaagatattcattcatttacttttctcagcaaccctatgagttgggtttttattattatccccattttacggtgaagaaactgaggcacaaattggttaagtaccatgccaaggcctcacagatggtaaattgtagagctaggattcacgcagtttggcctcagagcctgctcccttatcatctaccctgtgcttctaaaattttaatgcgcgtagaagtccccaggggattttgttaaaatttggattctaattcagtagatctgggatggggcctaggagtctgcatttctaacaagctcccaggtggtgttgatgctacagatttatggaccacattttgagaggcaagaacataacttatgagataatttctattattgttcccattttcaggtaagtactctgaagctcaaagaggatagtggtattaccagcttctcatagcaaatatacagtgaagctgtaattagaattcctgcagttgggtgtcaagtgtgattgcctaactgctctgcttaggtgcttggtaaatggctattgaatgataactaaactgatattcagtttactgctgggtctaacagatggctattatatagtcaaaggttggaatgtattgaatagaactcaaataattatatgccttccgtctgttctttttacaccttggaaatgaatctagtatcaattttcatctttaccacattttcttctcatagcctaagcaggttgttccacccttgctgttagcagggaacacaaaggaaacaactcagcaagttttcgttgaggatatctttctgtgggcctgtttaccattgcctttgcttttgaaaaaatagcacagaactggaatcctgctgatataaatatttctcattaaattgtctgaatagcgatcccagtagatatagaagcaatattattcaaaataattaaaaaataatgccactatttaaggttttgcaaaaatattattttccacttttgtacaaaaggaaatattttcatcagtagccttgactcacactcagtgcaattttgtggtggatgagattcaggctcccattccccattgtgtcctaataccatggatttcctccatgaagggtctcctgagaacaaggcccatcagagatcaaaacaagaatcaaatttagtgttctctataacaattcaaccattaatgttccaggaagaactctctatccactcctaccactctgaaatattttccaaccagataatgcatatatatatgtgacaaagagcctttgcctggaagaaaatttatttacttattagattattttaagaggcacttcttggctcagagaactggagggaacaaaatatataatataaaatatgtggctcataaaaatatgtgacttcacacaaccaaaatcaggggcgaaatgctagcatctctacattgtaatggggtccagtgttaaaaaaggactcttggctggattttattgactagcattctaaagttgttactttctctgcagaaatgtcagggaggtactagcttgtctcatttatcactgatgggaataataaacctgactagaagatcagtgactgtattcactcattcatacattcagttcctaaataaagattgttgagcatcactatgctaggaacttgaggtaacaaggagaatagcatatggtttctgccctcagggagttcacaaaattactagggatataatacaaacaggaacaaggttaacagtaggagatggtatgtgacaaggataatacaaatggtacacagtttcttagagtagtgttttatcagagtggtccctgggccagcacatcagtatcatctagggacttgtttgatattcagattcttgggccatacctcagacccactgaatctgaacctttgtggatggaccccagcggtctgacttttaacaagatcctaaggtgatttgtatgtacattaaaacttaaaagtgctcttttgaaagatcacttctatcagaggaagaacaacacattaaggtcttgtccttgagagcttataactcaaaaaaatgacatttgaatgtgaataatcaaatctgataagaaacactcacacatgtgactataggaacaaggaaaagtgggtgggggggagggagagagagagagattgactgatttaaccctgtggtagttggagagactggtgaatgtttcctggaggggccgttggaggatgaagaaatgctgtcagtttgaagtgcatttggctgtaacagaaaacctgactgagagtgatttaaagaagaagggtttttgtttctcacataagtagcctggaggtaggcagtctccagcgctgattcagttatttaaggatgccagggttctgggtcagcgtctccttagacctcttgctttctgccttatgatcaatcataagatggctgctgtagctctgaaaatcacattctcatccaaccatattcaaatgcaagaagcagataggcatagcacaaaaagatccctcttctgcattcttatcaaggtggcaactcttttctagaggcctcccagcaaatctccactatgtctgatttactagaactagaacataagactaccagtataccagggtctgttcaactttccatgacttctagtaatctcagcccaatattccaggaggatagagctgctgttagcagggagcaagtgcgtttcagtgggaaagcttttgagtaagccaccaacagcctatagccaggaagactagagtagatggaatcaggagtaagggcatttccccaaagagggaaaggcatgaatgaaggcatggaggtgaagtgtgcatgaagaatgattactagatgagtttggctaaagcatatgagtcttacaaaggaatttttagccattaaaaaaaatctgtggaaccttttgttcaattggaatcatgtgcagaaacccaattcacagaggaaagcatacctgcttcagtcagaagtagggtgggatgcctggagccagcctgctctgtctctgacctacttcagctgaaagggcttcttgaaagccaaactgaagaacaatgtcccagaaactgctactttgaccctgccacacccaagattctctgggcccctctccctgcaggaggccacaaggcattcatcaaggtccctcatttggccccaaactggagcttcacaggtatgtatggaaatataataatccaggctaggggtacctgtgtatgcgtttttgtggtgttgctttttgcagataccacatgtgaccctgtgtctcttaattccattcctgacactgaattgctaaaacagtagttgaggagagcattgtggtaaaacaactagaggaaggggaacactattagtggtgattagtggcttgcctcttcacttcctgcccttacaaccctgtgttagtttcctagtgtggtcataacaaagtaccatggattaggtggtttaaacatcagaaatgtattatctcacagttctgaaggccagatgtcagatcaaagtgttggcagggttggtccctcctgagggctgtaaggggaatctgttttatgccccttccataacttctgatggtttgctagcagtctttgatattccttggcttgtagatctctgccttcatcttcatatgacgtattccctgtatgccttcacattgtcttccctgtgtgcatgactgtctttgtgttcagatgtccccattttataagacacagtcatattggattaaaacccaccctgatgacttcatcttaacttgatcatctgttttcgaataaagttatattcacaagtactagaggttaggacttcatctctgtttggagagacacaattcaaccagggaattgtggaagatggcaatgaagatttatcccatcttcattcaacccctaacacatcctatatttcaaacctttgcttccctttttctaaggccttctcctctcactcttaatcctagtggctatgctccagttgtttaactcttgttatggtggaattgagtgggaaagatgggttatttcaaggaatgtttcatcctcactattctgtttgaagacataattgtgtagaataatgtttgaaaataaacactggcactcaattatattaattcaagattgaattataattcaatcttgtgcatgggatcctaagtttgaataaaaaagtgcagaatcaaaagaccaaataaaaattatcacaattattaccaacattaccttgtatagcactttcgcacagattatcatttgaaagcatattcttttctaccagcaatcaagatccccttttcacatctacttttgcttgacaataaattctccttgaggatgtttcctgacaggattgtctgcggaaaatcctttacttagagttgtaaccagaatcttcctaaatttagcagagttcatacaacactgagctgaaacccaagtaagggagatggacagagacaataaatgagacactgaagaaatataaaatggaatttaaaaactgtaaattttaggggggtaagggcacttacaaaagtggggttaaagaaccaagttatttttagattatgtggtcctaatttggcagcatactttattattaaattttgaaacttgctaatgaaatactagttcttagtgacaaaatctgcccttgatcaaggaagcaaaaaggagaagttactccgcaggtatcagtctctccactttcttacattcaattctgttgtcaaatgttaagactgtttcctctcattcagtggaaatttccttcagcttatttttcctggaaatggaaaacagctgcgcagagccttcattcaaccctctactcaaaggctcttatttgcatcatcaactatttgcttttctctatcccaatctatcaataaactaagttcacatctcttcttcagagcatttttctccctcagtgtggatgccccatcctcataaaagcatgacacttagtcattgtttatactgtcattcctacctagaaacgtctttccctcttaatttttttggaaaaatgtaccccatcttccttcaagacttagccagggagagagctctggagcacatttgggaaggcatgaaatggggaagcccccaggaaggaaggtagacaaatcctcaggggacacagcctggttttctcctctgtgtagactcctaatgtgccattcccaagatgctcctcaatattgacgagtggggttttctggaactgtacattcctaagagccagttgacttctagagtgaaatacagaatgtgggaatctccagagaaagaaagcccaaggcaaaagagtaagtaactcttagagtctcagacatggaaagataactggtaacacttggctgctggagaatgaaacccctcctaaaggcagatattcaggcctgtgatagaatcattgaatttcatctacctagttcccatcaggcctggggaaatggggataagctgcagagtctacatggtcttacagaagctgaagcaagttgcagagaaatttcaaggacttttaagtccagtataccttggatttggggcactactccagcacaaattcctccctgcttcatgcagattttcattgccgatggccccacttccagaaccagaaattccaacattcctatggcggtcttactttccgttgccccaggaagcagaaatggggacaagactgcaagactgaccatgagaccatggcctggactgaggggctcagctactttcttaagtaccttcagaccagagataacagctgtttggaacatataaatgagaccttgtctctggaacaatcatctggctttggttattcattatcattgaaccccacatgcctcacttagaaagatgtcccttccaaagctcagaggccctcaccatcgcatgcatgctcctctcctagtacacttctggagtggcctgaagagctggagaagtgggcactcagctcacatctcaacccagatctccacagatcacatccttgtttctgtcacatcagtagtcagtagtgcccccatctcatttatatccaaattaagaacatcttaatatgagatttcatcctttccagattgacccatctggatttggatatctcagtaacaagatactttgtcctttttcatcattacttagctcctcagtttgcaatatttgtgtgtccctattattcttgtccagttatacaagccttgaggtaatgcactgtcttttattagtttttcagactccacacagagattgacacagcactggcagaacacatagataccattgcttaataagaaaattcaagatacttggttgattctgaaggacatcacttctgggatcctgagctacaggcattaagcttaaggaaaacctggttgaagatcatctttatggtgaaaataagtgttggtggatcaatagcaacccattacagatattttcacattcactgaaataaaactttaaaagtggcactctaactaaagagaatatcaataacattttatcactttaatatttggttacttttttctattttcctcagctcactgctatttcaatgaaatgatttgttttgctttgttgaagaaaatattcattagttaaaagataattttggactatgtctggttgtatgtccaaatattcggtctttctgattttatgagatagttgaccctgaactccaagtggcccaccttagttaatcaccatattccagggatgtgaaggaacttggaagcttgaaatggaataagctgcattggagccagttgcactcagcccccttccccttggctggtggtatccctttggccctgcttcatggctttaggccaaattgcctcctgtcagcatccctcatacacctctccctggtgccgcgtgaggatagttcacagttctgtggcctgggatgactctcatcttccttcatctttcccaagacattattgccaaacactctcctcctctaccattgttttacctcctaatcctcaggtctctttttttctaagaaccacccccgtcccctgagattgttcccttcaacttgacatttccctggaatcacaattcttatagtggtaaaaaggtgtcagaattatatgtacatgaaaggaactcaagttggagagaaacttggatacccataaaggaaagtttccaatgctttcatgtcaatactttagctcattttacaacccaccgcctatatatcttgtgcaagtcattttctttctttggaatcaataagggttccctgtgtcttctctggcatttcccaaacagggttgtcatgataatggagattgtgcaaaaagagggacttactatcaaatactttttttttttttgcaaactctatcccactcttagagattcatactacactgagaaatcctacactgaaaaaaaaatttttttaactttcccaagtatttaaccacaggagcctccccaccgtttcccttatactaatcatctgttatcatctggtagcacaaaattttgtaaatgcatgagtaatacatgaattgcacacttcttcatgtcttttgagcctgctgcaaactgaactgagcttctctattcaacctgaatgttatctttttctccttcacaacatgatatgttattgcactggtgtctatttgatcaatttgctggtggtccatcagtaggcctttgctaatgctgttttccccacctggatgttcttacttttaggtacagcttatgttctaaatcccttctccaactgcctatactctgtctccattactgtaccagattaagacctacttttgtccttacaactgtacattcccataagacatggctatatcacatccaactgcactatttctccttagctccttttgaggatataagaaattcactaaacaccacttcattgattgatggattatgaggatattatttcaactgtacaattggcaccttttcataggcagtttttctacattgagtgcagggtcattttttgttgttgtttgttttttgtttttagctaggtacagttcagttcttacctaagaatacaactatcctgcattcaccaccatgaaagccagtgcacttatttccactttattttaaggagagcatgaatgttgtggatttatttactttttctaatttaagagaactggccactttgaaattttatagtgtctcagtgcctgagaaacacttaattctcctgaaccagctataacataggtgtaaattgatggtattgtcccttcagcctttctgtagtagaagatgcaccaagataatgtagacattatctttgctgtgtcctcagagttatgtaaataaccctacttcccttcctagctgaaaaactgtcattagtttgtgtttcaggtcattctctgtctactgaatgaaattcaatagtccttgaaaattcagccttccccaatctaatcactacatcattgttttaaaaagtgattcttttaaaagcattgatttttaaaggctattagtttttgtttttgtttgctttttaaaatacttttagtactgttcaattatttattatatgatttatttttattaactagaattcattttttaaagtattgcatgtacttggtaaaaacaaaaataaaaacacatccaagtgtacaaaagagtatataaaatgagagctaagtctttctctcacctcagattcccagtatccagttctcattcccacaagcaaccaattttacatgtttgtgaatctttccaggaatatcctaaacatatccatgagcatgcatatgtgaatggaacatgctatgcatactgtatataacctgttttttatttgacattatatgttgtgtagctttctatatcaatacatatagatctgccttattgctttcatggttgaatggtatttcattgtatatagatgtaccacacttcatttaactagtaccctagtaacagacattttagttgtttccagtcttgccattgaatataacactgcagtgagttatacatacatctttgtatatctgggaaaatatttattggaattaagacaattttttatcaatgttgccaaattgccttccaaagaggtagcgcctgttgacctctctcaacggtgtatgagagtgcctgtttccccacaaatcgcctgtgctataaattttacttacccatttcttccactctgcaagattaaaaatggtagctcattttaatttgcatttctcaaattaggaatgaagataatctttgcatatgttttaagtcttttgcatattattgtatgcaaatttcttgttcatgtcctttcccatttttcccattgaattgttgctctttttctaactactttgtaaaatttaaaatattaatatcatgttatgtattttgctaacatatataaaatcattcctctgtgttttgttctactgtaacttttatgattacttttttgatgtttaaatattttgtccatctggaaattaatttattaaattaatgtaaaaataacacaatttaaatcactgtaagttccatgaaaacagaggccaagattctttcattagccattgtatacctagtgtcagacacatttatttagtactaattgtggccaaaatataatgggtagcacatttccgggattttctttgctcttcttatctgcctcctctaagaagcttctctgacctgacgttctgaggaataagaggtcataccaccgtttactgaaacatcagcagttggttggcagtggtggatgtgacagtagtgatcagggagtcaacactgctcctggccttcactgcttcctcctcaagatgctcagagccttgagtaaccccaataagtgtatcagctcacattcaccactttcatggcacccccttgtgagatttagccacttttcaactgcctgtgtatagaagaaaacccacactattgtatcctggtcaggctgcgggcactagggagaaggggaagttatagaagactctttggagagctcattgactatggcagctaccatgcagtaccatgtggtgacactcctgggtggttacaaattgaagctcacctgtatcactagtttggaatagggctggatgaacttcaaaacactgttttagttagttatatttaaatacctaacaaatatccctaaatctcagtgtattacaacaacaaaaagtttttatttttcctcactcatggggcatctctgtgtggattcagcttggctgcatgtgtgtctgtcctgttcttcttggactgtcagttacccaaagcatcttctttttacagaaattgcagaagttccaaaggaccagccaaaaccataccaccatattgagctcacaaatgccaagttgaagggacctcctggtagcttctgcgtacccataatagaacacaacacagggtactgataaagataatggattttggagcctcacaacactggaatggcagacactgttatctctccttcttccatggtgatggatcctagtccccagagtcgagactcacaatgtcagatacttctccatccttccttgctgctgtaggtagccatgttacacggttctggctaaagagatatcaggagagctcttccaggtgtccttgaaattttttttttttcctgtttgagcaagctacttttcagtacctcagtgttctcatctgcaaatttgggctaggtataatgtacagaggtgttgtactagtcaattcttgctttgtaacaatccaaaatctcaatggttttcaataacaaatactgatttttttgccaataggtctgcaggtcatctgggattgctctgcttcaggctgtatgcagggttcaactctatatgtttcaagacaagacaaactatgcaagcttttgcttatatcactaacattcctttgatcaaagcaattcacatggccaagaccattaatagggcacagaaatatgcttcagccacaatggaaagcagtacagttacatggcaaagatgtggatatataatcctattacaatagaatgaagactgaacaatattccattccatcttctcacttctcacgcttcctaggtgtgtagacataagcaagctactagcttctcagaaacttagtttcctcatcctcaagatggcagtgggcccttttctctgagttggtgtaaagatagacagaaatcatttgccataggagacccttaacaaaagttagctcttcactcccacaactcagttctgattgtttactatctaagcttctcccagaagataggtgtgtgatttaatattggcattccatgagttgatgagtgaatgaggtcaccaatatgacagctccctgagggaggaagcaaaccatttattcactaagcaagtattgagcacctgaaatcattatttcaaggtcattgtcatgctttttcatgcttcaataactggaatttttttctttttttggcagatgacccttaactcactctgacaagatcatatgaacactgatattttaagactgattttgactgctttataggctccttctactggagtaaaatggtatcttttttttcctgaagacttcaagatagtttcactttaatcaaaagcaaatgcagtaaacaatttgctgcattgctagactgccttttcatatagtgtttctgctgccatgtcccaaatttacctgtcacagagctataatactgactggtacttctttttaaaacagagctttaccaaaggcactgattttaaagaatggtccaggaatgtgaattaataataagcagcttcttgttccctgtgagtaacgcccttgttacttcaattctaaccttctcagttttagaacatctgtgagtattatgggaaggctgtgttggacctatttagaggtgcttgctaagaggaaatgatctctagtcaccaggtttgctatgttatgtaggtagactatgattttctatagaaaaaatgaggatggatgcaaagccaacacttctttgccagggagagccatcctttcttggggcatacacattgtcaaggctgtcaaaatgagatttcttgtgaatcttttaaataaagccattattcattgtttaatgcttatggagtttctctttatttctggctcggcagtatgccatatatgtctccttctttcccacctcttcacctttttggagtcactttttctatttaaattacatagtaggatatttcagcgagatctgaactgattgattaaaagaagcttctatgtgatagtgtagaatagaggagaatctcacagtaatgctgactccagggtatgtgaggtagtggtaacacctccagtcctgccatagccaaaaacagtgttctcctacagctttgaaactcaaaggatgctctgaatcagcatcccctggcatcacctggggacttacagatgcagaatctcaggcctcacagcacacctactgactctgtactttaacaagattgccagggaatcagcatgtacattacaatgtgggaaatactggtctagagtaagaggaaagcacacagtaatgccaacactgaggtattggcattactcagtgagagagtgctagcacctcagaatctgtcatagccaggaacagcttactcctgtattccactgaggtctatgattaacacccatgggcccagggccagctccacccattagctttataacagtgggcagtaagcccacaacctctgccctgaaatcagtgctcagtatctttgttgactggtacttcctgattttgacctcatggaccctgacctcttgcacctaccaatctatgttccactgacttggctgatttagctgactaccatagtacgtttaatttattagctggtgatctttgtcaaactcctgtgttctagaccttcccagcttgaatgtaaccaggcttaatgtaaccacaccttactgttgagatagtgttaaaagagcctgtgggtctttaacagctaaatccttaaattagtcataactttttcaattttaggcaatagaaattcaacttgaaataacataattttaaaagagggggcaccagtatgggtcaaatatcatgtctctctaaatatgatgttctgcaaaggacaggacatcacttttgagattttcctgccccaaatgcgtaaggtaactttaatcatgaggaacatcatacacatccaaattgagggacatcttgtaaaataaattgcctgtactcttcgaaaatttgtcaagaaagagaaaggctcagaactatcctacattaatgaagtataaagggaagtgacaattaaatgtaatgtgtgatttttttcaacttgatgttttttttattattattatactttaagatttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccctttcctgtgtccatgtgttctcattgttcaattcccacctatgagtgagaacatgtggtgtttggttttttgtccctgcgatagtttactgagaatgacgatttctaatttcatccatgtccctacaaaggatatgaactcatcattttttatggctgcatagtattccatggtgtatatgtaccacattttcttaatccagtctatcattgttggacatttgggttggttccaagtctttgctattgtgaatagtgctgcaataaacatacgtgtgcatgtgtcgttatagcagcatgatttatagtcctttgggtgtatgcccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgggcattttttcatgtgttttttggctgcataaatgtcttcttttgagaagtgtctgttcatgtccttcgcccactttttgatggggttgtttgtttttttcttgtaaatttgtttgagttcactgtagattctggatattagccctttgtcagatgagtaggttgcgaaaattttctcccattttgtaggttgcctgttcactctgatggtagtttcttttgctgtgcagaagctctcttgtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcacagcaccatttattaaatagggaatcctttccccattgcttatttttgtcaggtttgtcaaagatcagatagttgtagatatgtggtgttatttctgagggctctgttctgttccattgatctagatctctgttttggtaccagtaccatgctgttttggttgctgtagccttgtagtatagtttgaagtcaggtagcgtgatgcctccagctttgttcttttggcttaggattgacttggcgatgcgggctcttttttggttccatatgaactttaaagtagtttttttccaattctgtgaagaaagtcattggtagcttgatggggatggcattgaatctataaattaccttgggcagtatggccattttcacgatattgattcttcctgcccatgagcatggaatattcttccatttctttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgcctgttattggtgtataagaatgcttgtggtatttgtacactgattttgtatcttgagactttgctaaagttgcttatcagcttaaggagattttgggctgagacgatggggttttctagatatataatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgtgtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttacatgctggattacatttattgatttgcgtatattgaaccagccttgcatcccagggatgaagcccacttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttaaggaggattccctctttttctattgattggaatagtttcagaaggaatggtaccagctcctccttgtacctctggtagaattcggctgtgaatccatctggtcctggactctttttcgttggtaagctattgattattgccagaatttcagatcctgttattgttctattcagagattcaatttcttcctggtttattgttgggagggtgtatgtgtcgagaaatttatccatttcttctagattttctagtttatttgtgtagaggtgtttatagtattctctgatggtagtttgtatttctgtgggattggtggtgatatcccctatatcattttttgttgtgtctatttgattcttctctcctttcttctttattaatcttgctagcagtctatcaattttgttgatcttttcaaaaaactagctcctggattcattgattttttgaagggttttttgtgtctctatttccttcagttctgctctgatcttagttatttcttgccttctgctagcttttgaatgtgtttgctcttgcttttctagttctttttattgtgatgttagggtgtcaattttggatctttcctgctttctcttgtgggcatttagtcctcgaaatttccctctacacactgctttgaatgtgtcccagagattcttgtatgttgtgtctttgttctcgttggtttcaaagaatatctttatttctgccttcattttgttatgtacccagtagtcattcaggagcaggttgttcagtttccatgtagttgagcggttttgagtgagtttcttaatcctgagttccagtttgattgcactgtggtctgagagacagtttgttataatttctgttcttttacatttgctgaggagagctttacttccaactatgtggtcaattttggaataggtgtggtgtggtgctgaaaaaaaatgtctattctgttgatttggggtggagagttctgtagatgtctattaggtctgcttggtgcagagctgagttcaattcctgggtatccttgttaactttctgtctcattgatctgtctaatgttgacagtggggtgttaaagtctcccattattattgtgtgggagtgtaagtctctttgtaggtcactcaggacttgctttatgaatctgggtgctcctgtattggttgcatatatatttaggatagttagctcttcttgttgaattgatccgtttaccattatgtaatgcccttctttgtctcttttgatctttgttggtttaaagtgtgttttatcagagactaggattgcaacccctgcctttttttattttccatttgcttggtagatcttcctccatccttttattttgagcctatgtgtgtctctgcatgtgagatgggtttcctgaatacagcactgtgatgggtcttgactctttatccaatttgccagtctgtgtcttttaattggagcatttagtccatttacatttaaagttaatattgttatgtgtgaatttgatcctgtcattgtgatgttagctggttattttgctcgttagttgatgcagtttcttcctagtgtcgatggtctttacaatttggcatgattttgcagtggctggtgccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttgtctttaagaatgttgaatattggcccccactctcttctggcttgtagagtttctgccaagagatcagctgttagtttgatgggcttccctttgtgggtaacccgacctttctctctggctgcccttaacattttttccttcatttcaactttggtgaatctgacaattatgtgtcttggagttgctcttctcgaggagtatctttgtggcattctctgtattttctgaatctgaatgttggcctgccttgctagattggggaagttctcctggataatatcctgcagattgttttccaacttggttccattctccccgtcactttcaggtacaccaatcagatgtagatttggtcttttcacatagtccgatatttcttggaggctttgttcgtttttttttttttattcttttttctctaaacttcccttctcacttcatttcattcatttcatcttccatcactgataccctttcttccagttgatcgcatcggttcctgaggcttctgcattcttcacttagttctcgagccttggctttcagctccggttattctagttatacattcgtctaaatttttttcaaagtttttaacttctttgcctttggtttgaatttcttcctgtagctcggggtagtttgatcatctgaagccttcttctctcacctcgtcaaagtcattctccatccagctttgttccattgctggtgaggaactgtgttcctttggaggaggagaggcgctctgctttttagagtttccagtttttccgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagtggattttcgtgaaccgcaaatgctgctgtctgatcgttcctctggaagttttgtctcagaggcgtacccggccatgtgagaagtcagtctgcccctgctgggggggtgcctcccagttaggctgctcgggggtcaggagtcagggacccacttgaggaggcagtctccccattctcagatctccagctgtgtgctgggagaaccactgctctcttcaaagctgtcagacagggacatttaagtcggcagaggttactgctgtctttttgtttgtctgtaccctgcccccagaggtggagcctacagaggcaggcaggcctccttgagctgtggtgggctccacccagttcgagcttccgggctcctttgtttacctaagcaagcctgggcaatggcgggcgcccctcccccagcctcactgccgccttgcagtttggtctcagactgctgtgctagcaatcagcaagactccgtggacgtaggacccttcgagacaggtgcaggatataatctcctggtgcgccgttttttaagcccgttggaaaagcgcagtattagggtgggagtgacccaattttccgattttccaggtgccgtctgttacccctttctttgactaggaaagagaactccctgaccccttgcgcttcctgagtgaggcaatgcctcgccctgcttcggctcgcacatggtgcgctgcacccactgtcctgcgcccactgtctggcactccctagtgagatgaacccggtacctcagatggaaatgcagaaatcacccatcttctgcgtcgctcgcgctgggagctgtagaccggagctgttcctgttcagccatcttggctgtcccctttgtaatgtgtgattttggattggttcctgtgacagaaaataaaatagctgtaagagatattattgggattattggaaaaatttaaatatagactagattagataatagtattgcataagtattagatttactgattttgataattgtactgtagttaggtaggagaatgtccatgtttataggaaatatatactgaagtatttctggataaagaggcatcatgtctgcaacttactccaaaacacctttcctccccaaatagaatgattgagcaaatgtggcaaaatgtgaacagaatattaccatgggtaaatggtatatgagaatttttgtactattcttaaaactctatggaattatatacaaaaattataggaataaaaataaattcaaagggatgttattactagatactgggaaacctcacagaattaaaaaaaaaagagcgacataagactcagggcagcatggaaaccttgaaaactggaagtgaaaacttgatgccactggaacaattctgatctggacagacttctttgacagagataatagaaacctggaactttagagcaagaaaagacttttaagatccgtttcatgaatgagaaaactgacatccagacagctaaagtaacttgcccaaagataatgaatatagtttccacttgcagacatttaagattccttttcctgttgatttttgaatggatacccaaagtttgttctctttcttacacttttaagttagaatatgagatgaagtaaggacaaaattaacaaataatgataaatatgctgtaacatgaatatatattctgtaaacaaatatctaaacatttccccacacacaattaacatgttctccccccaaattttgtccttatatgtgtataataaaatatttaaacattaaaaaccataggtaagcatagtctttttgtatcatttaacacacctgtccctatccccaccttccccttcccctttccaacctctagtatcctctgttctactttttatttttatgagatcaacttttttattatatagtttgagatagctagaaagaggatttcgaacattcccaacaaaagaaatcacaaatgtttgagatgatggatgctaattaccctgatctgataactatatttaatatatatatatataaacacatcactatgtaccctatgaatatgtatagttattacttaatttttttttaacttttagcttcaagggtacatgtgtaggtttgctacataggtaaattgtgtgtcacggggggtttggtgtacagattatttcatcacccaggtaataagcaatagtattcaataggtaggtttttgatcctcactcttctccctcccccaccctcaagtaggccccagtgtctattgtttctttctttgcatccatgtgtactcagtgtttagctcccacttataagtgagaatatgcagtatttggttttctgttcctgtgctagttcacttaggataatggatagagcctccagctccattcatgctgctgaaaaggacatgatctcattcttttcatggctgcatagtattccatggtgtatatgtactacatttcctttatccagtctaccattgatgggcatttagtttgattccatgtgtttgctattgtgaatagtgctgtgatggacatacatgtgcatgtgtctttatgatagaatgatatctattcctttgggtatatacccaataatggacttgctgggtcaaatggtggttcgttttaagttctctgagaagtcaccaaactgctttccacagtggctgaagtaatttacattcctacaagccatgtataagcattcccctttctctgcaacctcaccagcatctgttagaaaaaataactttttaaaaagcttgcgtaattgtctttcatgacaatcttatatgaaagtcagctagaaatttgaatttcttcgcttattatatgggtaagtacagtctgtcctcttccatgacatttttctcacctcgtagaatacattgactctcaattgaaaaacaatgctaatctagacaattcttagaaatgtccctcatgatgtggagtgactatgattgcagtccatttagaaagtataatatcaagcatggggggtgcctagaagccatctagtctgtctattccttttaaaggtgaagactgtttgcacttggttacttaaacactttcttcatctcttgcacctgtttcatagtaaggaacagattttaaatggaatattatctatttgcatatattgaaataatagttatctttagatcacttctgaagtagtatatttagagaaagccaagcatcctctaagcatgctttctacagttctatattacttttggtttagaaaaggcctttgtgtagtgattagacagttatattcagagctgagaaagcagccttgaccaattatctccacaacagctttggaaatagaatgcaaatcctagccaaaggatcctaggtggtggagcacaaaattgaatatatagtgacatagtgtgtggcaagaagcagtgcatttttgaaaaaggaattaagtgtgccttccatcatctgtgttcagacatgatcatgaatggctaacataaattttcagacaatatggattcctatagttcagtgtggtgacggacactattgccgaccagagctctttttgccacattgtccttactaatataaccctacttttatttgacatagcgatttttgccaataattgcttgatttttcagcttttctttctgtcaggtttgccatgtcatataacactagctaatgacatgtcagtgtaaatatgctagggtattctgggaaaccttttggtttcctgataaaagagaatacatgcgcgtggccccttcctcccatttcttcccaccttgaatgtaaacatggtgtctggagttggcagcagccattttgtgcctatagtccaccatgaagtaaggaagtgcaaattgtgtcatcctggctctgacatcacaagtcactaagcaatatcagcagtcagccagtttcagactttttgttacatgagaaaaatgacctgttgtttgattaagccactagaagtgagattttctattcatttaagttaaatacattcctgatacaaatagagtagacccttctgggaatgtctgcctagctcagaataaccccatttctctgtgaagtttcgtcctacttctcctctcggtggatcattgcagccatcttgaattagttggccctgctccttcagctagagtggatgccattgtgtaaacacacctgaatgaggctgaacctgaatgaggctgaatgtatcagattctcctaggaatttaaaattgggtttcagtaactctatttgatcctgtaatgtgactaaaacttagggatatgtttaaacttggaatgagagagagagagagaaagaaagagagagataatatgatgggaggtcaccttcagccacagaaaagtagagaaagaagacttgtagaaagtgaaagagaggcagagacccatgtcaccaagagagagaacactggctacagcctggaggatttctgggtccaagcattggttccttcttggtcctagctgccctcaggtttcaggagctgactcagctttcttccagatagggggacaggcaaggttgtgccctgtataaaggcacctggtcaaaagggcaggggaagtgaaatccagtcatggtgttctggtcaccaagccctggcatgagggtgtatcagcctggaggtaatgtactcttttatgtaattcctcttcccagtagggtgtgtacttttttctatttccaatagtcttaggaagaccctacttcaggatacctagtaaagttgttgcctcctacttacaaccaaagggccttgacattcagacaaaatgtattaacagacagctaaactattcattctaccatataacagatatgctgttcaattccctgatttatttttgcttttttataaaaaaaattgaagtatagtttacatatagcaaaatgtacaaatcttaagggtataactcagtgaattaactgtgcatttcatacatctattaaccagatcaatatacagagcatttccatcaatctagaaggttcctttatcccaatgaatatcattcaccccacacacacacacccaaacccccaaacaggtaggtaaccacttttctgacctctatcaccatactttgattttgaacttcatagagatggaatcatacagcaaatactcttttgtgtctcacctcttttttcattgttcatgacatccagccatgttgctgcatgtatcagtaattggttctctttttattcttaagtaatagtccattgtatgaatataccatcatttatttattcattctgttgacgtatatttaggaagtttccagattttaactcttatggataaagctgctgtacatattcttatacaaatgggcctaggcatttatttcccttggatgttgatgcactgtaatagatatccatattatatatatatccatatatacatacatatacacacacatatatacatgtatgtatatatatgtatgtgtgtacctacatacatatacacacatacatatatatacatacatgtatatatgtgtgtgtatatgtatattatatatatatataacatgcatgtatgtaggtaaattctgtcttgagtcgttccttcacattgtaattgagagaccgtatttttaaagtactgcttcatgaccaattacatatctagtgaacatgttctctttacatattaaacatgaggctactcagtatcatggggaagcctgctttggtttatttaaaaagtggtaaatggtcagtagtattttgtgttacagctaatgaggcaaacttatagtgagggtacctggcattaagcttataattaaaagtctagtctgtgactaggaaaatatccagctatgctacatgaaccacatgagattaagctcagttgcttgttctaaccacctgtgctatttgcaatactaaataatgctggatttgctatgcaaagccctgtaaagcagtgtctgtgtcccagcatcacacgtggagctttttttaaaaaaaatgagtgtctgattcttctctcttacttcccccaaagtcttggtctagattgagatctctgtttgtttgttttgttttgttttgttttgttttaactcaccatgtaattatgtgctatagcagctggccatttctttcatatgtccatccttacaattttggcgattgccttcagttgaattcacattggagactatgaatgagttttatctcctgttaaactttccccaggcaacacgaggtgacggtacacaattcacttaatattgattactttataaacatgccctcattaaaataataacaaattatggacagtggcagaataagacacatttggcgaaataaaacatggagcatgatatgagtttattcagactaccccactagtatgttatattaggctgttttcacactgctataaagaactatttgagactgtgtaatttataaagaaaagagctttaattgactcacagttgcacatggctggggaggcctcaggaaacttagaatcatgttggaaggggaagtaggcacttatttacatggcggcaggagagagagcacaaagagggaagtacctcacttttaaaccatcagatctcctgaaaactgagatctgagaacagcaatggggaagcccgcccccatgattcaatcacctcccacaaggcccttcccccgacatgtgaggattacgatttgagatgagatttgggtgggaacacagagccaaaccgtatcaaatgtaatctccatagtggcagagacttttctctcttttgctcactgatgttctcctagtaagccatagcagggctcaataattatcatagaacaaatctttgtctaagacaaagaccttagttactaacttacaaggttataaatcctgctttgcctactactggttacacatctcagttgctcatctcagccattccagggccagtaggctccccagctgcattcatttgacagtgaccatttgaaacttgtcaaagattaaatctaaggaagagaatttgggtaacttcttacccttaacagagtaagggtgtcaatttaccttctctcctcttcagccatagagccagctccccctgaagtcctctattcctttctccttccactaggcataaaacaaaaattgaatctggccatggtgtcacttttgttcctggtagttaggggatgcagatggtggtggcaactcccttgatcacaccttcatgctctggtcacctcaaatatcctttttagatatgccatttacatagaaaatgattctatctgaattttatattctagctctcctaaagattactggttaaaattattaaaagaagccagaaaaagagaaaccagaaatattttccctttaaaataccagaaaatgtcaacataacaaaactgctgctttggacatgatcacacagaggatggattccctacagtacataaatgaataaggggagaaggatggaaacatatatgtccattttatttcatatatatatatataaaatatatttcccagaaaggacctgggaagttacttcattttgcagatgaatacagtgaagccagagaggttaaatcactgactcagggccatattacgacaaagctagaagttctgaattttccaaccatggttaccagaccccccgacataccccgtagctttaggtttcatgttatacacagaaaaggtaccattcatggcccaaccagcactatatcacactgcttcctctacatccaaggaatacatttattaaaatgtattttaaggtactaaaggaaaaaggaagaaagatctaagcaattttaaagtatctctgccttcccttctgcaattatgaccttcagggcatccatcaatcctacaggcccatgtcaaagaacatgggaaaagatatcttttcagcttgttctgttgaaagcatctaggtgaaagagctattaagccttaaaatgtcacaaattgttcagatattgttcaaccaggaccatttttgtgaatacctctctgagatgatgacaaaataggtagtacataatagagtcacttgagtggagggaactgtggctcctggaaaagaagataattgcttcatagcacttggtgctaaagctcccacaggcctcctctttgtcttcccaaagtgacttttaaggatttgaggatctactgtcatggtgacggattggagggtgtccattgcccctgacctgaagctggataagtggaagaaatagggaggtcacccagggcaatggcagcaaagagtgttttctactctttgtccctgggctctaggatagcacttaacgagaaaaatcaattgcaaccttgtgagtgcagtcagaactggaaactgcatttaaatttgcctactcaggcagtcagccccactttaaagagctttagagttagagatttctgtggcaacagaggtgcacgtgggcaaaaattgctttgcagggtagtgaaggctagcaatgttgttagattggcactttatggctgcccagtttatgtgggcttggctgtaagtaacccaatgaacagtgactttttaaaaagggattagattttctcttataacaagagtttggatataggtggtcctggttgtggtacagatgctcaataatgtccaaaaatcccagaatttttctttctcctccatcattctcagaatgttggcctttcattcatgtgctcatagctgcagaatgcaaattggctgctactacttcaggcctcacatatatattcaaggcagccaaaaaaaaggaaaggaagataacagccatgtatgtccattttatttccatgtattatgaaacaaaaagctttccatgaagctcctgcagattcctccattgatcaagtgaggccacatagccaaccctagctacaaggaatgcagggtacttggcaagggacaatgggatttatatgtttggctaaggctaattactgtcacttagggctagacacaattgccagcctaataaaactgatattcagttagcaagaaataaagagaaaagagatgtcgctaactaatagtgtaagccactatgaattcagaattggcctttcaaaataggaagggcatttactgtatatttgacaataagcaactattcatccctatatttctatactctctagtacattatcatgtaccaaacaggcacttgaacattttgaaccatggtttgagaatactgtaatgacatactcatttaacagtggcttagagaaaggtatgatgtgaaatagtcaacaaagcattcagccttaataatgtcggcattcactttgggtacatcaggagactgacaactgcagataattcaagtaactgatgccaggaagctacaaagtgttctagtcctttaagcttcctattaggaagaaagtacataagaaaatagacatattgataaaataaaatgcctagaataggacaagttgaacctgtgttctagtttcaccacaaaagattttttgccttttctctaagaaattaaactgctgaaacatactatcatgttcacattaaagaattacagcccaaatctatatacagtatatagatttataaatgtcataaagacttgaatcataaaatgctatatgtgtaagacacattaaagaccgcctcagcctgacttcttatttttccagatgaggaactgaggtccagagaagttgcatgatttgtctaaagttatatagttagttcgtatctagaaaccagataaacttgggagacattttgaaagagcaaaggaatgacattttgggaaaagtgggacagagaaggctgcaagtgtggtgatgataaaagtaaatacacagacatgaagggtcatacattgctagtttatgaattaaaagttagaacaatttaggaatgcaggctgacataagctggtccttgggtggaagatgaggtataggaagtaggcaacagcatggttattttatgagaagtatgctgagctcaaacctccaaggcctggagttcagtcactattggacttcagatgtcccttttcactatagcttgcaggcattgtgcatgtgctttatgctaggaaccgtgctaagtatcttatatgaaacccttacagcaacccagtgacatagatcttattatcactactttttacaaatgagaagaatgaggctaagaaagaataagtaactcacaaattcacactactagaaagtggtaaagctaagtttggaactcaggtgtatcttacccccaagtccctgtttatcaccatgctattctcctttttatgttcaaaaaccagattcctccaatgctttggagaaccatagagcttggaacctagaggcaccttagatgtcacctagtacagtgctactcaagaggtgcttttctggccaggagcatcaccatcacccaagatcttgttagaaatgcaagacctcaggccccactccacagctactgagtcagaatctctgagggtgaggcctgggaagctgtgttttagcaggatcactagatggtttttaggaacactaacatttgagaagctgtggccagtgaatagatactagtccagcccctttattttagatgaagaaatggaggtctgatgacttaaccatgggtatggtgccaaaggagcctcaagccctgatctcctgattcctagtccagtgcactgtctgctgtgttctgtggtttcctcattagcttcccacaatgtgcattggtgcctgtgttggaaacactggatggcatttagtagacttctggcctgacccagcatgttcattcatgtgcacatcaggtttctccttccattcctccatgactcagaccaaaggcatttctctatactcgggaggtcttttccatattttccctgtagccctcctcttcttcattatcataatcatagtattattactttgctttttaaaactacttttgcattcattcagtatttcatgtcagcagttctcaaccttgacactctttgtaataacgtggagagcttaaaaaggatactcatccctgggtcccacgcccagagagtctgatgtaatcagtgtcgggtgtggacagggcattgggatttttaaaagctccccaggtgattgcagtatgcagtcaaacgttgggaactgctttttcataagagtctcattattacctgaggagataggtggggcaaacgtaatcctgtttttgtagataaggaagcttgtgctctgagacatttagtgtcttagaagaaagagaataaaatcatctagtgacagttggtgcagactgggttaccagctacttctgataaatctttaaagccagcagtcaggctgtaagaatggggtaaaacctgtttttcttttctggtttctagtgttttctgggtttatgtttcttcacatgagaagggaaaagaaacaactgtgaaatggtacctgggaccaaatgtttataactgaaattccatgctgaatccctttaatgactggaggataatcatcaactagagcaacctgcttcctattcctcatagcccagcataataatgatcagggagcatcaggaaaaccagatggaagggacttgctcattctgcaccagcacacatgccccatttagagaccagttaagaaaataacaaacctggccacactggctaaaagagctcctcagtggagcatgcaaatatggacatgtctgtcttacatgcagaatattggaagagaatttcttatcgttgctgtgtcccttttctgggtaatctaatcatttaaatgataatatgcaacacttttgcttgatgcttcctctcgctgccttgaatgtcgttgggaacttctattgttccttcggtctaacttctcaccttttccaaaagaaatcctctgctgcaaccagcctctctattttcataatcctttgctacttcaagtgtggttgatgaaccagcagtgtcagcctcagcatcactactgttgtaacaaggagcttgttagtaacagaatcctggccccatcctagacctaccgaattagaatctttgttttttatcaagagccccaagtaatgtgtgtgcaccttgaggtttttgaagcattgccccaatacacaggactctccccatcatccaataagttaaaaatgctctcttccccatgctttcatttacccacttcctacttgtccttcaaagctcagctcatattcctcttcctctatgaagccaatatttactccattcacgttactcctttacagtactacttttaggatttaaatgaatgctgaatatttcattatttaaatgttttgcatgtctacttagtctcattattaagattccatgtttctccaacctagcataggctttgcacataatactcatgaattattcagtttgtcaagatcagtttcctacttgaaggtttttcttaagccctattttgtatctttaagcttgctcaacaccttttctgctcatgatgttctctggaggtcactatgcactgtaagagtgctcatgatgttcttcctcaaagaagctcctccaagtttctgtcttctcaataccttaagtaaatctttatctgctacagagatttcctgaaaggcctggctctttcttgtaacctagtggattccaagtgaactacaaccccaaagagatataggaagtaaaaatttaaccacttgtgaatattgactttgtataaacaatttctctaactttttaatttgaaataatttggactgggaattttaaaaaataagtttaattttggagatgagatgttttactactctgttctggtgcccataggaaactcaggatcatcttctgctgtttcatgtgggacaggccacgtggtggtatctcttttgctggtcccagaccctgaagcaagagacacacctctgaggctgccatcttcctgagttccaggcaaaagggaggcacatatcctaacaaactgtagatcctcaaacctgtctggaggcctgttgtaagactcctaaggcttggcatgatgggatggaggtaggaaagcaggaacaccacactcacactgactttcaacttctggtttcttttctatgtcaactcatcccaccttgaacagcttgtatctccatcctgagtttattcggaactatccttcaaatccattgttttatggtatcaattttaagtattaaaaatacccaggaggctgggtgtggtggctcacacctgtaatcccagcactttgggaggccgaggcgggcagatcacgaggtcaggaaatcgagaccatcctggctaagagggtgcaaccccgtctctactaaaaatacaaaaaattagccaggcgtggtggcaggcgcctgtagtcccatctacttgggaggctgaggcaggagaatggcatgaacctgggagacagagcttgcagtgagctgagatcatgccactgcactccagcctgggcgacagggcaagacttcatcaaaaaaacaaaaaaacaaaaaaacaaaacaaaacccaggatctaacaacccaaaaacttttttctttattgttcatgcgtatcaaaagtcatttgtctcattccagtagctctaactttaaaaaaagacatacaaaaaagtcattttgatgtttattgggtagtcagatggcttctttctctaggcagaagcctatcctaccaacaggatgatgaggcaaaggattgggtgaaataaattgctgggtgaaaacattaagttaatatcagattcttactctgttacatatatgtttgctatgatatcagagtgaccctgcattctatgcagatgggcactcagggcattttggactcttgcatgataatgttggtggtgcttgagcaaggcctagggtgggaagtctagcacctccttacagttgtttcagattctgtaaggattgcctgtcaggtcagacttagaactgtacttctgcactaataattcattgtcaccttaagacgcatactccgtatattgtaaaaatgtttccttgggctctacccacttccaaaaacgtgtttggggtggtttacaacaaaaattcacaaatacagtgaaaccattaaccattcaacatggattaaggtttaagaggtaaaatgtttatagcaaaacccctagggtaaaggaagtttctgcactaagcacaggaattaactctgccttttggccctcaagactaagacaaactctcacttcactttgttaggtgggctatgagggtagcttatcacttaggccttcatacagaggcgttagaaaactgtgaacaatatcttcaacagcagttttacaaaacttgtctttttttaaaaaatcaacctttcctttatatagaaaccaaagccacgatagtcatagttagaaaaaataatctgtggaaagccagatttgtatactccagatatacagtgttgtcaggacctaacctaatattgggaaatttaaataatttatagctaatgtatcttaagccagtgcttctcaaactttcatgggcatatgctaccatctggtgatctttttaaaattcagtttcttggctagccatgtgcagaaaacagaaactgtaccccttccttacaccttatacaaaaattaactcaagatggattaaagacttaaatgtaaaacccaaaaccataaaaaccctagaagaaaacctagacaataccattcatgacacaggcatgggcaaagacttcatgacgaaaacgccaaaagcaattgcaacaaaagccaaaattgacaaatgggatctaattaaactaaagagcttctgcacagcaaaagaaactttcatcagagtgaacaggtgacatacggaatgggagaaaatttttgcaatctactcatctgacaaaggtctaatatccagaatttacaaggaacttaaacaaatttacaagaaaaaaacaaccctacaaaaagtgggcaaagatctgaacagacacttctcaaaagaagacatttacatggccaaaaaacatgaaaaaaatttcaacatcactgatcattagagaaatgcaaatcaaaaccacaatgagacaccatctcatgccagtcagaatggcaattattaaaaagtcaagaaacaatagatgctggtgaggctgtggagaaataggaagacttttacactgttggtgggagtgtaaattagttcaaccattgtgtaagatagtatggtgattcctcagggatctagaaccagaaataccatttgacccagtaatcccattactgggtatatacccaaaggaatataaattattctactataaagacacatgcacatgtatgtttattgcagcactatttacaatagcaaagtcatggaaacaacccaaatgcccatcaatgatagactggataaagaaaatgtagcacatatataccacggaatattatgcagccataaaaaggaatgagatcatgtcctttgcagggacatgaatgaagctggaaggcatcatcctcagcaaactaacacaggaacagaaaaccaaacactgcatgttctcactcataagtgggagttgaacaatgagaacacatggacacagggagaggaacaacacacaccaggtcctgttgggggatggggggcatggggagggaacttagaggacaggtcaataggtacagcaaaccaccatgacacacgtatacctatgtaacaaacctgcacattctgcacatgtatcccagaacttaaagtaaaataaaacaataaaaaataaattaaaacaaataaaattcagtttctaattcactgggtctgggctggggcctgggaatttgaatttctatcaggatacctttactgctggtccatggaccacactttgaggagcatatacctcttagagatatcagaggtctcaaatgggcaattgacagaagtttgaggacagataatttaagactggacagataattctgagtcctccatgactcacaccaaaggcatttctttatacctgggagttcttttgctagttttccctttagccctcgtcttcatcattattattatattgtattatattattattactttggttttaagaactatttttgcactcacttagtattttatggcagtagttctcaaccttgaccactctttgtaatccactggggagcttaaaaaagatcccggccaggcgtggtggttcacgcctgtaatcccaccactttgggaggccaaggtgggcagatcgcccgaggtcaggaattcgagaccagcctggccaacatggtgaaaccccgtctctgctaaaaacacaaaaaattagccaggtgtggtggtgggcacctgtaatcccagtgactcaggaggctgaggcagaagaattgctttaatccaggaggtggaggttgcagtgagccaagatcgtgccactgcactccagcctgggtgactgagtgaaactccatctcagggaaaaaaaaaaaaaaaagccccaatgccgggtcccatgcccagaagagtcttagcatgtaccttatcatgcaccatagatgcaggtatctttgttattttgagtgaaaggatctagtatggtaggtaggaaaactgatgtgtttatgtgagggatgaaacgacaaatgaaaggtttggctttatattcatatctattctagttaggctctttttgcaagaaactgagactctcaaatgactaaaaagaaagggcggagtatgggggtgggtattgtatggaaaattggtaggaagccctaaagggagtagccctaaactgttaggaagagggagctataaggacgagctacttttctttaactttctctcttggtatcattgtttcttttagcatatctgctgcagtctcctttcactctcttttttttttctctttttttttattattatactttaagttctagggtacatgtgcacaatgtgcaggttcgttacatatgtatacatgtgccatgttggtgtgctgcacccattaacttgtcatttatatctcctaatgctatccctcctccctccccccaccccacgacaggccccagtgtgtgatgttccccaccttgtgtccaggtgttctcattgttcaatttccacctatgaatgagaacatgtggtgtttggttttctgtccttgagatagtttgctcagaatgatggtttccagcttcatccatggccctacaaaggacaagaactcatccttttttatggctgcatagtattccatggtgtatatatgccacattttcttaatccagtctatcactgatggacatttgggttggttccaagtctttactattgtgaatagtgcagcaagaaacatacatgtgcatgtgtctttacggcagcatgatttataatcctttgggtgtatacccagtaatgggatggctgggtcaaatggtatttctagttctagatctttaaggaatcgccacactgtcttccacaatgaaaaaaaccattatttaaaaaattaattattttatctgtgcggttatgcctttaacttgacatgcagttaaatttgtttcattttatgactttttaaagtctttagagttggcaattttgttattctttatagttaagtttatgttttttaactaattaaaagacttaccaatattagaaaatagaaataatgtgaatatgcacactcacattctttttatttgtgtcctttttcctaatccctctttactgatataataaactttctttttctggtttttgcaagtttttttttttatactttaagttctagggtacatgtgcacaatgtgcaggtttgttacatatgtatacatgcgccatgctggtgtgctgcactcattaactcgtcatttacattaggtatatctcctaatgctatccctcctccctcccccaaccccatgacaggccccagtgtgtgatgttccccttcctgtgtccaggtgttctcattgttcaattcccacctatgagtgagaacatgtggtgtttggtcagtctcctttcactctcactgctggtcagtctcctttcactctcactgctgggtggtttattctgtttttctccatcacagcccctgcttactccctgttgacctcagtttatgcatggacccattcctgacctgtcttcagcagcagctgggattgctgacagcttcattttttttttttttgaacatgcatttcaaattgttgagaggaggaatttgattggcattgtatgccttaggacactggcacacccaagacttagttgctattcgcatattcagtcagtgctgatgggggaggggcaggaggtgtttgatgcctagaaaaagaaatacagctagcaaagactgccacttcctgtaggtaggactcttgccttgggaaggagtcagtggtgaggccagcattctgtggtttggtcctttttattgacttttttttttcaaagaaagtcatctctcctctgcatggaggtagttcagtcatagcatgactttcaggcagggccaagaaatatagtatgagctttattgccctcttgtctcttcatactcaggccaaaccaataggaatatttcacaaggtcagtaaagtgaatcagttaaactaaacaaaacggtttaaaccaaaccacctcagatttgcttcgtatttttgaaatatcttaatttattttaattcaatgtaaaaagaaaagaatctattccatccaaaatatcaacaaatgcattgatcttaggggctacaactacaggagagggaataatttgggtttgtttggtgaaggcctgatggccagggagccccgctctgccattcctagtcatttttgttcccccaccggaaatgctgctccctcattcccaggatctcagagtgtctcaaaagcacagaggccatctttggaggcagtgggtgtgctcatgcttgtgctcctgtgtactaggggcagagagtggagggatatttgagaaagcagacacaggagaacaagctcaagcccttaccccagaatctcaactcccttcttctttctgtactgtttgttcgggggcgaaaaatactcttcctcagtgttccccacacacaggcttttaatgaactctgtttttagtttttatttgctgatcagtaaactgagggtaggtcttgtctgttcccagagataaagaactgcatgcataactggtctctatccagccgaacaagcgccggtttctctttgtttttcacagtgtttctgagagataagaggaaaccacccagacatgatacatgaccatgggaggttttgaaataatattttataaactcattccctattctaagctgtggattcgggatagaaagaaagggggagggcaccacatatagtgtaagttgatttttttctgggttaaaaataagcaggcaaacacacacgtacacagacatgcacacacacacacacacaacatatgaataaatgttcagctggggaaataagccaattttcagttataggcatgaaagtcaaataggaaaaattttagtagtgcaaatgaatacatccctgaaaattcagtgactgtttcctaccacaaaaacttcctctgtcatatggattcaaaatcaatattgagcagagccagatatattcccagaagactatgggattcaatcaggatagagtccaattaagtgcatgcccttcagggcttttagcaggtttctgagaaagaggggttgatttgagacaaatgatgatgcaagattttaagtagtgtaagactaaacttaagatcagttggcactgataaagacacaaagagtaaatgttttcaataccaaatgaaaattatggtagcaatttgaatggttgtatttaatcatttaggagaaatttgctattaagctaaggaaagaagacttggggctgatatgataggacagtggggatgcagcataggaagatagggtcttcaggaatgttaggaggagtacacttaagagacagagagagtggttaataaaagggaaatttaagttgaaagccatgacatcattatttcagcaaatagaaaaaaaaaaaagagaatgtagtcttactgaagccgagtccatcttacctactctgcattactgtttctttctatctctaggctcatgagctttagttgctctattgtagactcttgtctatatctcatctccagtgctggatggtaacttgcctgtagggaaaaaatatgtctcatggtttctcaaatttctccacaacacctagtgtgggaccttactggaatagtagctcaataaatgttaattggcagaattaattaatgaatggtatcctcatgaagtaattatttttccaaattaaatgctagattttgggaaaccaaagctggattatattttttccttctaataccaggtaaatcagaggagcaatttatgaataaatcattagaaacttatttcaaaaggaattggctggtctaatgctggatattgggtaggaaaattaaatgtgtcagttttaggagagaggccaaaatccaacggactttttattgatcccagattcattcaatcagactaaacttagatgttttttagttttggttaatctgaccagtacgtttcctgtgcaggtctaccttttgggaagattggcttcatgagagcacaggttctgtctatcttgctcactgtcatatctccagcatccagaacagtcttgcctggaatgtagtagaggcttaagaaacaatcgtggagcggagggaaagagagggacggaggaagcgaataaagaatgaagggagggagggctctgaatttcataccagttaaactgtcacttatttactcactcatcggttgtgaaggacccccctcagactctgtgttaggcaccaaggataccaaaattatgaggtgccacagtgtttgctctcaaagaactgatagtctagtgagagagaaagagagagctctaacacaacagagagagatctaacacaacagtgctgtgcagcagagcaaatgtcactgtcataaagggagtgtgccaaagggaacatctaatttgtcccaggaagggcaggatgcaaaacatatggctaacctgagcagaatcttaataaatgcaatgatgctttgaaggcttgagaaccgtttaatctctatagtcctaaaaccgactgtggacagattgaataaaacatggaagactgcaagtcattacattttagccattctctattcagagtcattttgatattagaagttattttgtgttgacactattggactttggtttcattcaggtagtacaaatgcctacagtgagtccgtcatactgcagcttatcacagaatcatggctttataagtacagtctttataagcacagtctaaataacacaaattgaaggtctgatgtttgggccagacctacactgtacaccaggagtaacagctttgttaagcataatcagttaggaccactatttgttcttttctgagcaaatccttgttcctgtgacaaggattaatgatatgacagccataaggtagtctttgtattttatagcaacctatagctgtaaaggtgtgtgttttccaccgaaatggcaagttttctaaagagggtaggtttgacaacttgacaacaaaggaagaatcagtggtaaaaaaagaataaattttcgttgactaagtttatttacatatagtacaggattctgtggatatgatgctagacttcttaagcaagaaaattcagtgtctaaggaaaaaggagatcctgctttgacttctacttctggatttccttattcaggtgctgactccagcacagatcaagtcaatttgtcaggcaattctggactctgggaagcagtatgccataaagaagaggaaaccattccccctgatgtattcttactatggaaccgaatacttgggtaagtgaaggtgtttgcatgggcctgtaggaaggagaaagtctctaagatactaccaaataaaggctggaagattttgtttttgccataggtcattactagtcatttaataagaaatactttaaaattttctttaaaaacctatactgatacataacacaaatcacaagttaatatttgttttcgtagtctacctgacagaaatgtagctattttaacaattactttcactaaagactaatatctttattctagattgtaagctcattggcctgattttgctgaaacattgtgaaaacttttcacacacgattgaaaatagtgcctctgcatagggaagtaggattcagccactaacgttttgaagtttttaatagtagtgtgtttataacagactattgaattgtaatggctaatggtgagctctgggccatgcaaaaaaaaaaaaagggaaattagttactcttcttttgagtccttcaatggcttaccattactactgagcaagatttgcaaggccctttatggaccacctgcctctttctctagactcaaactttatctttaccctccaggttctgtccagcatagtctcccacatgcggtgttctctttccacctttgtccatgttccttttgcctagaatgccctacttcccccaacccctttatctatctgtaataattatacccagatttcaagactctgctcaaacatcattaatctgctgaaaaatgttccgtgcttttggaaaaagggttgttgaatcctctctggagaaagattcacaagtttcaggttttctcccaaagcaaaactgggtaacatgctgtcatcctgcgtatacttctattggagcccttattacactgtaattagtggcttacctgcctaactgcctgagcaggctttgtacaccttcaggatgggaactttctctcatttatcttcatgattcttagaccttcaccacagagcttgcaaataattagggaacccaaatgaatgaatgaatagctaataaacaacttcaatgagttttctcaaagaaattttatgtctgtttaagtttccccaaaatcaaacgctgagacaaggatttgggtgtaaaaggtttatttgaaaggtaatttcagaaagtgttgatagagatgtggagaaatgagacaagaaagagaaagaagctaattgagtgtgtaataatgagcaactgtggacaactgaggctcagttcccctagggaatcttagagactttatagaacacatctcagaatcgtttcacccaaggggtgaggaagctggggtattcatccaccaactctctgctttattgattggctgctcctagaggtattaattccctagcaattctgtcctgcccctttgggcagggcatactcctgtggccagagaaagcctcaggcaaaatgatagatgcttgagatatgaagcgggagcaaagatgcatctgaatgttgagtgtagatgaggtgatgagccagggcactgacagtgtctgctatagtcccctaatctattccattcatttttctggttttattttttgagacaaggtcttgctctgtcacccaggctggagtgcaatggtgtgatcatagctcacgcaacctcgacctcctgagctcagttgatcctcctgcctcagccttccaagtagctaggactacaggtatgcttcagtatgcctggtcaaatttttatctttaattttttttttttttttttatagagacagggtcttgttatgttgctcaggctggccttgaattcctggctcaagtgatcctaccaccttagcctcccagtatttttcaggttttcgttacagaaattaacattctggctttttacatatatatagcttaaactatatttctatctagtgcataaatattttcctgaaaagcaagctttttttcccaacaatttcgaatccagcaaaataaagatattttcacatttcatgatcagattttaagagcaatagaaattttgactgaatacaaactgtaaagctgtttccagggagtcaagagttctgagtatggcaaagtaaaagatccctgaatgcaaaaagaaagctttaaagttatagagttgagtttaaagagcaagccatcagaatacattgaccctagtactgcccactaatcgggattctactaactgggaatgagtgaaaactcctagagggactggactttgacctttgttaagctaacttcttttccaaaggcaggttcaggcctttgctagttcaatacccattgctagttcagaattctctgaggaattctcaagactttgctcagatgacactgtctgtatggaaccttcagcatcccctccacctctgaggccaagttaagctctcctccattccttctattagtccttgtagtagtcatggttctctagacaaacagaatatgatttcttatataactaaatgatttattgtaaggaattggctcacatgattatggaggctgagaaagccagatccaggaaagccaataatgtaagttccagtttgaatccaaatctgaaggcaggagaaggccaatgtcccagttcaaagacagtcaggcaggacaaactaattatttcttactcagactctttattctattcaggccttcagtgaattggatgaggtccacccacattggagagagcaatgtgcttagctcagtgaacaggttcaaatgttatttttatccagaaacaccctcacagacacacccagaagtgacgtttaaccaaatatctggacactccatggccaagtcaagttgacacacacaattaaccatcatactcctggtacacattgctcatagaacacttatcatgtcatgttctaattatttctttacaaatctggccgtttcattggactggatggagaggtcttcaaatgtatcgaccaaatcatgtttatctgtataaccagggttagacagtgcctaatatgcaagtgttaaatgtaaaggattaagtaaatgaatatcaataactagtgttaacattacaaaagagggatttagtctgttttgtgcagtgatctatcctctgtacctagaacagtatcttgtacagagtagatgcttaatacttgtgtgtcgaatgaataaaaaaataaatgtttaggatacctagaccaaattattttcaagcattttaggagcattttcatgaaagctactgatatttcaattacaaagttttaaaagatctcttctctaaaacagagtttggtcagcaaattttttctgtaaagggctagagacagtaaatattttcagctttctgggccgtatggcctctgtcacaaatacaacactgctgttgtagccagaaagcagcaatagaaaatatgcaaatgaatgagcatggctattctttaataaaactttatttagaaaaactggcagtgagccatatttggcctgcaggctatagtttgctagaagcctagttcttaggcaacttagttatcacattgctatatgagctttcaagtaatattggctttattgttttatatcctgttgatcttttcactaaatcaaactagctgtcctcccaattgtgtgaattttatgccttgtttgttaatacaggggcagctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggtctcacacactctgttacctaaaaatattgcctttcatctaggttagccacagggtggttccttttctgagaagtgaggatagctaatcttatgtcattactatgtgagataaaagggtcaagatgagatttttcaaagccaaatgtcctgatcagtaaacaacttctgaaaatggtcctctacattttaaaatatatgatctatatctatttgtttataaagttaaactaacattgtccaatagaagtataatatgagccacatatgtaattttcatttttagtaacctcattaaaaaagtaaaatcaggcaaattaattttaataatatatattatagttcccagtgtacccccaatattaccatctccatgtatatctgatttgaaaattgagatatttcacattttaaaaagtattcagtccttgaaatccagcatatactttatacttatgtcaaatgtcaatttagactagccacatttcaagtgctcagtatctacattggatagtgcagatctggagcctggcaattcaaaatgtggcccctggaaccagtagcatgagcaactgagagcttgataaaaatccagaatctcaggccccaccctagacccactgaatcaaaatctacattttaacagtatccttagacaaatcgtatgcactttaaaggttgggatgcactgttctacaacttcttcaaatgagaatttccatcagtaccaaacaaaatgtctagaaacatgaatagtcatccccagtaaactctgtggaattgaggctagaaatttagcaaaccctatctttttcccacttttaaaaaattccatcacactgctattaagccttcacagaaggggtaatttgaaaaaaagttaaattcaaataaataaattaatattggttagatggccaggggagagatttaaaataccaaaataatacaaaattcttagattctgagtcgatttaattttcaaggccatgcttcaatcccacaagcacagttttaaaatatatttgatttctctgtagtttttttacctgagtttcattaccttttcctcccattaattaatggtctttaatccaactataatttcattttggggggtacagtttgagttgatgaataataatccttgaaagtatagtcttgagttgatgaataatgtaagtcgcagtgtattggtcatattttttctgcctgctacatttacctatggaaggaagttcaaaatgtgtgcttgtaccagtatccatgcattgtgtgttatgtccaggctaacttctgccaattatgatttgagcccatttctttttaatttgaccttttttgtgggcggggggggaacaagttatttaccatgctggaaatgatatttcttcttgttagcctcaatccttccatttctcatttattttaattattctcagtgatggtctctggatatcctccaagcataccagcaaggatccttgaattttggagacataccaatttaaacacagaatatcttaaaaggattcaatgtgctagtaatagtcctgaaaaaagtgggaagataatctactaaaatgaatgactgggtcagttaattgatgtgggtgtcttgcagggcaattattccatcctttctgtatactaaataccatctgtctttgtaaatcatttaccgtaacagtgcagcataggattcatcactttggagactatatcctcctttatcattcatgttcagtatctagagaagattaaacataagttttaaagaaaaatctttcagtccatgtattcactggactaccaaaaataaaccaattcaaaaatgaataaaaaactaagtggggcccattattttaccaacccctatccccacctcaagggtattggtctttctttgaagagatgctctaaaaacagcatcaagattgattataagtctaatcagtgcagtccaaagaccaccaagattttgcagaggttggcaacatctccaaaaattctatgcaggaaacgaactataaaataattttcatttatttaaggaaaacatttttgagagtagatttatgaacagtgcagatggtttgaggcagcagactaattctgtgattaaaaacctgccagaaataattcacaacgtggagcttcattaatgataccttatctgttcctataattgtttcctactggtgctccttcaacccacctccacaggtgacaagcctagttatcatttatgcagtgtagaaatagttctttgagttaataactccagcttctaatttcagctccaacactaaccagtttactgaccttaagaaagggtgactttgtttctttagtgcctttgtctctttatctgtgaaatgagcactttgagactgagtagtggaactcaatctttttatcaccacagacccccttttatactttggtcctttgccattcctgagggctgttcctcaagagctttgtgaacaagacatttttaaataccttgtgtggcatatagcttttttctcaataagtgcagtaaagtattacaggaagattaatgtgaccccttcataaccttgacaattctgaaatacaggaccaaagtcatttacaaaatcattaaaacaaatgctgtggctaaaagaaactctcaaccgcattaggttacatcattgctgtggtaacactgacaatgcatttccttgactctgcatgaagtacaggagtgggtatttttttaaaaaaactcatttcataaaagctcttgggtaggtgactttgaataaagaacaacaaggcttttgcagtgcagatatcgttggtcattaagctctgtagtgcgcactgtacaatgcatgcctcagcggaattacacaacccagaatggacctcagtggtgattctccagtgtgttgaagctatacgtgccaagtgtggctgtcacaaggtcctattagatcccatattttcaaaagtttagtctctcaaaacatatttattaagtaataattctttttcccagttgcatttggcaaagtcatacatcattactgactcaggcttcttatcaatgcacaataattagtgttcctatgatgaaatgatgtggctcctggttcctatcaaaagcaaagaaacccaccattcctttttttttttttttaattaagcagccttattgtggcttccattatgctgggttaggagccaacaggtttactaaattttggtttagaagttttgcgaggtcacttccatgtaacattctgtgatccaggatgcaggaagaggctctttcaccctggccagaaccacaggatcaataccttttaagcgttctggggctcatggcctggtacagcaattagaccatctcacccttcttccttctacatctctcatctataccccagtatcagcctgtgctgggttgagaaatggggcactttatggtcaacagacatgtatgaggttcttggcatttgccagacaccatgccacacactagtggaacaaaagtgaacaacatacagtttctgctcttgagtagtttgcactgtattaggggaggcagccatggaaataggtaattttaactgggttctgtgtaagtgctaaagtttgtataggatcaatgaaatctcagaggggttcctcatgctgccttcaggtccagggaaggcttcctggaggttgtgatgcctaaggtaagttagccagatcaagaaaggtacaaagcttgttccaagcaaagtgaaccacattggtagtaagaagcatggaagcactgtaggtggtttggttctactgaagtgaaaagtttcaagaagggaatggaggaaaagaggtgggaaaatagaaaaggagctcagtcacaaggggctttctgtgtcatgctaaggcatctgggtaatagggagtcatttagtagtttaagcaggggaatgtcatggtcagattacggtcctagaaaggtcattcactctgccacagaatgaatttaaggcatggcagacctggggacaggaggctaaagcaatcatctaagaaggacacctagagcctgagagaggccagcaagagcagggtcttcccacccaccttcctttgattggctgtaataccctccttcttcaccaagctctttcctcaggttctagaattagagcttggtatcaagaggaacctgtaagggagcagggaagcagaacaggccaaagaggagcatgtcttacctggagactagcttcaccctgagtctgaggagaagctaagaaacacagtttacatcaagaagctgggtctctcttgaggcaaggaagtcaatattttgtatccctgtgtcatccctgtgaggggtggctgcatagcatagcctctcatttgtctgagggcaaatctctcaagaagatgcagcagtgagctttgttagttgccaactttcacaggaactgggaaatgaggcacttgctggcaaggtaaagctgatccatgcaggtcatcaacagcatccagtacaccttgctaattccttatcaacccccaataatcaggttagatggtgtcacccctctagtagtcatctccttctaccaagtgtgtgctaggggccctcctgtgtgcttccatgagacttctatttcccctcacatagtctaattaatacttccagttaagctgaaaaacaccatgaagatagatgctttttaaaagcttaacacctgctactgtgcctggcatatagcagatgcccaattaatatagaaacacttaccaagttctgtgaaatgtctctttcattgactttctatttttttagagaagctttttttgtttcttttttttattgaggtgaaatttacataatatacaattaaccactttattattttttattttctccacttttactttgattcagagggtacatgtgctggtttgttacatgggtaaattgcatgtcactggggtttggcgtacaaaggattttgtcatgcaggtagtgagcatagtaccgaataggtagtttttcaacccttaccctcttcctaccctccctcctcaagtaggccctggtgtctattgttcctatctttgtgtccatgtgttctcatcatttagctcccacttataagtgagaacatgtggtgcttggttttctgttcctgcattcatttcctaaggataatggcctccagcaccatccatgttcctggacataatctctttttttatggctgcatagtattccatggtgtgtatgtaccacattttatttatccattccaccactgatgggcatctaggttgactccatgtgtttgctactgtgaatagtgctgtgatgaacatacacgtcattggcttcatttttgtctttctgctaacataaccagctcacagctaccctgttacccttctttaggtctctcctgataccactaaaattgggacattttgtccataataatcacattgtcatataaaaaataaaagccaaccaatccaaagcaaaaacacttccattgattccctgatgaccacagagtacagtccaagctatctaattagatttgtaaaaccatccataatcagaacccagtctagccttcttccccactggtctgttggttagaacattgccccactagccttcatgtggcttcttcctgcctccatgtctttgcccttgctaatcttagtgctagatagaatgccctccctgcttcatcttgggcctggaattctctatgtatccttcaaagttctgaaaaagtgctccttccatttaaggcctcatctaactatctccgtagggaacttccacctttctgattctgctagtattattgagagaaccatttattttatgttccagcagcatcatgaaatatatatcctattatgtatcagtcatatgcatatatttttatctccctttttagagagtgccttcctgaagggtaggagtcatgtttagcatttattcaatatcacccagggctggaactgactatataatttgggaggcccatagcaaaatgaaaatgcaagttatttttagaaaaattattaagaatttcaaggtggtaatagcagagcattaaactcaacatggaacccttttaaggagtatgggctgtaggcctgcacaggtggcatgcccatgattccagccttgtctagggctgtgcgtacagtacataatcaatgactactctcaaatgaatggatgcaatgaatgaatgaatgtatgaataaataagttcagttcttttaatatcatcatttagtttgtgcaaggtactttgttcctaaaactgaggtaggagaatgctgtaggtaaacattgtcagtagttgactggaaagcattgactgaacaaagagcttgttgctttgtaagtattaaccacaggctatattaaaggatacacttaaaaagggtatgaaatcatgactctcatacaaatataaaaagaatatgtatgaaccattttactgagctcattatttaatgagggaaccagaaagatgttacaactgtttcaaagggaaatccaaagagtagacatatttatataggccattaggaatgctgaaataaatttgcttaatagatgcaaaactggcttcttccacagaggcagagggaagtcaacctctaccagacagagtgtgagtttctagggacagaaaatatttacattactatcagttttctacaagacaatttctatctctacagagttgtaaaatagcctagtcaaagcaatgaaaggcaatgataaccctgattgatgaggtagtcaagataccagctatatttcagtctttcacactttttatataggagaaaggtaggctatgcaggagagaatgtgatcttgtgataccaacctcctcactgaatatgaacacccagaacttggggaaaatcatttctattaatagctgttgcttctcttgtttctcttgtaactgatactacttttgttgaagagctttgaaggaacagttctttccttggaacaatcagggtgggaaggactcacttcacagctaaagtagaagtcttggcaagatccttctggagcattgtttttcttggaaaaactcccagttttgcttttaagaaaatgtgtatagttataagtacttaaacattacaaattttaaactacaaattcattacaatacaaatatttagccatttcaaataaccaaatatacataatgcttactagagtatgcgtcattaaatattaacccatttgtaaattaaattttagattttatcaatctatgtacgtcaataaaaatgttgctctttctcccggggccaaccccacaatacaattaaaacaaattaaaatctcactgggaaaataagattctcttatagaacattctagcaccttcctactcaaagtgtggtctttagaaggatgcttgttagaaatgcagtatctcagggcccacatcagaactacaatattagaatctgtgttttaccagtactcaggtgattcatgagctttttattgttctggaagttctgctccaaagtattaagtcctgaaagtcacctctaatatctttgatgttttcacaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaaggtcagctgttctttatgggtctttttttttttcaaaattttaatctaattatttttctgaattactaatatagtcacatggtttgaaaagcataaaaataaatacatcaactgtgccttgtagccatgcagttgacttccctagagacagtttcttggttatcttcccaaagatattctatatacatagtgtataagtaaatgtcttaatccatttgagttgctataaaggaatacttgagggtgggtaatttatcaagaaaaagtttcctctggctcatgattctgcaggctctacaagaagcatcactagcatctgcttttggtgaaagcttcaggaagcttctactcatggcagaaggggaaggaaaacagacatcacatggggagagaagaagggagagaggaggaaagtgccaggctctttttaacagtcatctcttgggagcaaatagagtgagagctcactaattaccagaggatggcatcaatctgttcatgagcaatctgcctctatgatccaaccatctcccactaggtcccacctccaatactggggatcaaatttcaacatgagatttgaagggtcaaatttctaaactataatacatatatatgtgtgtgtgtgtgtgtcttagggggatatttaggttatttctaatattgtgtactacaaataatgctatgatgactaatcttgtgcatatataattttgcacatgtataggtatatctgaaagataaatttctagaaatgaaattgctggactatatatatatatatatatcctagttatatatataaatatatatatcctagttatatacataaatatatatatatttataattttgacaatataaaattttcctttatagttcattccctgtaaacttgataaagatggaacatctgctgtataccagacaacattgcttttaatagatattacctctgactggtaagctgggtaaactgggccaggaggaccataaatgaactctaaataatctgatagaaagcacaagtaggggcttccctgaatgcagagtggcatgaaagtggcattcattttgaagggacttagaagctgtccataaccatgaatggttacaaaagatattgttttcctttgtggcacttaggtcttctaagccagagtgttctctcatacccacccatgtagtctggttcccatgaatctgagctgtcacttggcagaggtgggagggggtcctagagtagcccctgtactgttgtgaagattcccactgaaagtgtacagctgataattatcaaattgattgtgtgacatttaacaaatcacttattaaaatgagctaagtgactgttaagtgatctttaacaaggtcacacaacctttaacaagtcacttagctcattttaacaagtgattctccatttcttcattcataaaatatggaaaatagtgcctacctcatagggatgtttggtagtttaaacaagttaatgtatgaaaaatcatttagaaataatgcttggcatatagtaactgcaatgtaaatgttcattgttattagtataaatttgagttttataattccagacttttctttatgtgtaaatgtatgttcacataaatgtatatgtgtacatgtatattttaatgagctcctactactatatatgtataatagttctatacatactgtttgtagcttataattttatttatttatttatttatttgagacagggtctcactcaggctggagtgcagtggtgtgatttatggctcactgtagcctgcaactcgtgggcacagctcagcctcctgagtagctagggctacaggttcatgccaccatatgtggctgatatggtttggatctgtgtccctaccaaatctcatgtcgaattgtaatccccagtgttggaggtggggccaagtaggaggtgattggatcctggggacagagttctcatgaatggtttggcaccatcccctcttggtactgtatagtgatagagttctcaagagatcttgttgtttaaaagtgcatagcacttccccctcccctcttgctcctgctctggccatgtaagatgtgtctgcttctccttcacttcctaccatgattggaagcttcctgaggcctccccagaagcagaagctgctatgattcctgtacagcctgcagaactatgagccaattaaacctcttttctttgtgaattacccagtctcaggtatttctttatagcagtgcaagaatggactaaaacaacaactattaattttttgtatgcagaaacaggatcttgctatgttgcccaggctggcattgaacacctggcctgaagctatcctcctgccttggccttccaaagtgctgggattacaggtgtgagcccaccacctccccgctatgtttgcagcttataattttaaatgaacaatttttaagggacattctttatttcattttgtatgaatctatctcattttttaaaatggctatatagttattcactatgcatgtatgataattaaccaatccttaaataatggacacttgacatttgtgtaatctttaataacacaaaatttccccaaatatccaatacatacatttctgtgcacttgtgaaagcacttgtcagaaattttagaattgaagtcattagatccataggtatttcttggtctataaatagcctgtctttatcctttgcccatttttttcctgttgtgatgcttctattcagaattgtaactctttgtcaatgtatgctgtaaataccttcctgctttgccatttctcttttaattttgtttgtagcctttgtcataccaaagttttaagtatttttcttgtcaaagttttcaatcttttctttaaaatttctagattttctgttatgcttaaaaagacccttcccacttcaggattagaaaactattaatttacatgggcttgtaataattttatgattttaacattaaaatttttgattctgctagaaattactttttaaatggtctcagataggtatttatttttgtttattaaaaaaaattctaatagcatctgttgaccagttacccccatgatttgaaattccatttttttataaactgaatttatataaatatatgagttccatattttccccatattccacctatcattctcttatttattcttttaattgtattttagagtcaatttgtcatatttttaaaaaagctcacagaaatttgattggaatttcattgaatttacagtttgcttaatgagaatcagcatctttagaatattgaatttttccatccagaaacatggtatacctttccatttatttaagtttaaacaaatgtcattggtaaagttttgatcttatgaagaagatcttgtatgttttttgttaattttattcctgggtattttatgtttctaggtttattgtgagtggactcttttccttcattatattttcatatcatttattactggtatttatggaagcttttaaaacacacatcactgaagtttatcaattctaatatgtaatttttcatataaatatagattgtatcttataagtatttttcttttcataaacatcataataatatagctgccttaatgaactccattactgtttctattagttttttattgattctattgggttttctaaatagatacacacatatctgcaaataactatgattctgttacttcctttctcatgtgcatggtattttttttccactacatggttcttctctataacaatgcaaccctataacaatgttcaataataagagggatagtaaacacccttgcttttatgctgattttactaggaatgctcctatgttttaccgtggtcttttatattcacttcttataatgtttatcattataaacattagattataagtgttagattataacacttctctgttcagtgtaatccaacggcttcccatatgattcagagtaaaagccagtctttcctacgaatgaaaggtcctacatgatctagcctcccattacctctctaatctcattccctactcttcttcctcctggttctgtctaccactgtggcttccttgtaattccattaggatgccaggtacactccacctcaagaccttggaagttttggttccctccacctgtaatgctcactttctacgtatatctcctagctcccccatttcagtcagactttcactcaaaagtcattttctcagaaaggccctcccaagtcaacttatctaatatttaatgtttagaaaacataaattattttttgtgatatttacatgaatgcactgaagggcaaatactaacttatgtaagtctttgatttgaagctctgttgtttaggaaatctgttaatataattgattcatggtttcttaatctctttaggtggaagccagacctgttgtttcccaaatatagaaaaagaaagtaattttggatatcatctaggctagtgggatttcacctttgggctaaatttcatcagaaatgaatgaaattcatttattccctataaagcgtattaaaagggatcagaacaacccctctattttcttttttgtaatttttaatattttaattttttaaaatttgtgtaaatgtatgggattcaagtttaattttgttatttggatagattacatagtggtgaattcagggctttagggtatccatcactcaatgaactttgtacccattaagtattttctggcaggccagtcctagcttacagagtcttggttataagatttagggtccaggtctctttagacaacttacatttctcactaacaggtagaagactggaaatgtggaggtaatatctgagtattgtttgggcattgtgtgaacaaaagttctctgaaacggaatgtgtaggaaagacactattccagtgaacagtttgcaaacagaggatacacggcctgcggtgtaaaatgaagcagcctttcagcgctgggttttatagcaaagttgcctgcccagggtcaggtctttttatgcaaatgaaggattgaatctcagttccgattggtcagtgcagctgagccctgattggccatggcaggtgactctgattgtttggcttaggtgtgatctgattagttactttccaagctcaaaaccagaagtctttgtcacctgtttcttccaaatggcgggtggagggctggcatatcttggcactcacaacgggaactggtttggagaaaggtcctgtgatgcttttacaacgtctttctcagaacacagagtacatgatcactccctcacccagccatagctgcctggttctgttttaacttggagcacctcagtttgccatggggagcccattttgtctgttggctaggggcatactttaacaattgcatgttaaaaaatatgtacctccctaaaatgaatattacttggttgtcacctattattttttaacatacagttggattttatggctgcataaaaatatttgacaacttcttaattttcttttatgtttattcaatcactcgggttttctacctcttctttttggtagtgcacatatttctataagaccatctagttcttatgaattttcaaatatttgacatagagttctaatcatatagttccataatatttttaatttcctatatctgtggctatgtgccctttgtgatttctaatgcttttccttcctggtgagctgcaccagtgttttttctgtcttgttaatcctttgaaggaactggctcctggttttgcttattaattttttttgtttttctcttttgttttccacttttacttccttttattttgttatgttctagagtttatacatgctgaattagaaagcattccatcattttattaataataatggtaactcacagatctatgaattttcttctgcattcagttttggtcataatcaatgggttttgatatgaaatgttttcatattttattgtgtcttctattctttttagtcctgtaattagcatgctgacttctattttgactgagaacgttttagaaaaaaaaatttgtttaattttgcaccactggatagatttttgaaacatttttcacaaataataacacaaaatacaggtcagaatacaatgaaactgctaccctcagacattgctggtactattttaagttgctatgtatcatttagaaattattttgaaaagcatagaaaaatatttagcatatttttaagtgaaaaaaatacaggataccaaatcatatatactttaataacatgtaataatgcaacaaataaatgagtgcatgggggaaaggtcagaagaagagctagcaacattgtgggtttcttttatactatgattttacaaatcatctttttgttttataaatcttcttttattatatgtttatgtaaaaagtaatattttctatttattgaatgcttgctatattctcagaacctgatatataataccctttatctttacatataacactatccagttctgcaacttcaccattttaaagtcaaattgagaaatttgccaaaggtcatacaacatgaaattatggaatctgtgtatctcacttccaaagcccttgctctttctactataccaggggttcttaatctaggatttgtgagtttgcttgacaaagagattgtgtctcaaacttaaatgtaacatttccttcttttctgaatgtaggtagtaagtcacagaagtattagtagctgtgactttgcaaacaatagaattcatagatattctcatgtcatattactcttgttgcagatattgtaaaatcttaattttacaatatgcagaaatgctagcagttactaaatccactattgtaccttggaatttaatgtgttagcaaataatacatatgttattatatcacaaatttggctttaaaatttttgttgtgttttaatataattattttcctttggaatcctgtgtggcttattttatacacttgaaaactttttttctgaggagcccaactgaagctatatcatgatgctggctatattattacaaatttagaagtaactcttacgatgcattaatagtctactgtttaaaattttaaattccattttaaaattgtttcatattcaggaaaacagttatagaaaaattgtaacaaatataattacaatctgttttctgctaatttattttaagttgccgtatgtaattctaagagccctaaaaaaatcaaataaataattaccctttgtaagaccccctatgtagtagcagtaacctaaatttatgacagtatcagcgcttgggccttaccaagctgtgaactccagcctctgaattggtgattatttgtgttcttgatgggaatgagtagagcaagtcagtaaaaaaagatgatgtaggtaatggcactttggaagctgtaaactactgtaaaaatgttacttgttaaaaataatctgaataatatttgtggcaaatatgggtaaaagaaaaaaggtctttcatagggaatttagaggcctgtgatttaatttaaggcgaatgtctcaaaaataatctgtcttgtagctgcgtttgctatatgatgttatcattgtgaaaggttgctgccttttcctattcatcttattcccttgtttgctcacagcacagattgtataaaatcttgcccatttatttttacagtctctgctttttgtcatatataaacaaaaacccagcttagaggtaatgtctgcagaaacacagcatatttacttttttaaaggaacagtcacgtatcactttgcttcttttcaagataaataaaagtagagcaatttgtctgtctttttttactttaattactggatgacagaaagaatgagatccttgaaaattccaaactgctttgctttgcaaactctaagaatagttggatttgcttgccagcataatttgttgtgaaacatacacagttatataatggatcttcttctttaacagagaaaatgtgtttcttaaaatacttaattatataattctggaaagaaaattatgctaaaactttaatagaagaggaagaagcaacccaaggtccataatatggaaacactcatgttaaactgttcatattttcttcttctcttaggtttgctcaattcttatttaccgaggaattcaaggccggttctcgggtccttgaaagtatatacagcttgtatgaaggcttctctgggacagtgtgctttctgattgacctgctgcagcccaatcaggctgaattcccactcttcagcgtctttgtttagaaggctctatcttccactgtggccctgcagagatcccctgagccaagccgaggcagtttccacataagccacattcaatggtatcgcaaccatgagccttaacattgccatcagaaggaaggaatcaggcaggtgaaggcaacatgatgccagatttgagaaaggatctgcaaaataaagataccacaattcatcttaaaactgcagagatttaatgtgtcagggaatagatgtgaaacaagggatcataggaaaaggggaaagagaaatgatctgtttttcagttatgacatagaaaaccaaactgcaagtgtagactatgacaaaaaatacactaatacctttgcaatctgaatgagaatttgaccatttgtgtgtgccctctacccttaaattcagaaataaagacaataaaaaattaaaataattgcccagctgaaaactgctatgaggaatggattgtcaggttgctgaagtataaaaataaactcttggttgtcctgtgcttatacttattgaaatttatggtttttactgagcaaagatatttgcatatgaatctctatttttttcattaccctgggcaatttaaagaaatcatatcatagcgtagttcagatactaaaatttgaagtttccttaggccctagaacatctcttttcctggttccttttttttcctcaaagctcaattagaatagcaaaatttataagctagtaaacttatactatagcaagtgttgctgtaaagtgtttttctccataggaagtgtgaactgtgtattgtctattgttagtaattttaaaaatgcctttatgtacataatcttgatggagctattagctgaactataaaatatgctcttggtaaatatcactaatttcaaagatcaggggaaccactacaaagacgtgtcatttctgcctttgtttgggacaggcagacaggctgaggaagtcaccagtgattgtggaaataattttgctccattttatactattaaatgaagagatgagtgaattctgtggttggttaccttaccttccaagatacagggtccactagaaattggctgtaatactcattgagccaagttgtcatatcaaattcaaccctgctgtaaacacatagaagttgtgaaactgcttcaagtaaatagtggtttgcagaacactgtaggagcatctgtcacttcattatgcagagcataagttgatccttttcctagaattttgtcagtggcaattgcatatatcagattgagtaggaaattgtgtactgtataagacttatttaaatagtcattaaatatttggatatattatgtgtgtgtgtgtgtgtgtgtgtgtgtgtatggtgtgtattccatatctattcccatgtaaatccaaatacttattctttatttcagtaattcttaacttgaatcatagactttggaacgagttagggaatgctctgttgcctaaaaagcaaacctacaagtatgttggtgtgtgtatgtgtatggaccagtttgtttgtgtgtgtgtgtgctcattttgaggggacaaggatctctagcattcataacattctcaaagaatctgaccaaagaaaggtaacaactatctttgtgtattttatgactgtgtgtgtttgcactcattgcaataaagtaggacaaaatgattttgaaatgcatacatcttttcagcttcctgtttcatttttacatcctcagatacaaccatatcaaattggcctcagttgttcatcagtgaaaatgctcagtttggggtgataccacataaatagcagctttcagatgactccccacattgggtccagaagttctttcatataggctgaatataataaccatcctatatacagagctttatggaacacatgcagtttttatcgtccaagaacccctcaagatgtgtttggtaaatgctccaaagtcttacagctagaaaaggacaaaaccaggattcaaacccagggtttcactttctaagtttatttattcagtattctagactagaatctggggatacaatagtgaacaaaataaactttccctcaaagctaccttctgtttccatttgctgttcctttcacaattcatccttgagacctgaaacctaaagcactcagaactgatactctagttcattatcatatcagttccatttctagtaacttcagaaaaacaagaccactttcaggcctatctgcccttttaagttctgataggtctgatgatgatgtgctaaccattttgatttgtgtgtcaaatctaagcaaagaccatgtttgagtattgtctttatgaaatgacatttcggtaaattagaaacaacaataggcttgtttagcccttaaacatgttgatgaaacttttcattttcctgaaagaattatagattttggaaggtcctcttctatattatttttccaagaaggggaaaacgattcttacattttgctgtaggaaagtgtggcatgttacttcttatttaattatccaacttgccccccttctctgtggtagcatttttaatgtagtacttaaggctgttgtctcttaaaggctacaggggcattttcaccaccactagtataactttaatattatttactatatacagcatgagcaattataaaccctgaaggtaatagtggaaatgtttgaggatacattgaaatagtctctcaataatggggagactgcattatgctttgatagcaagacattttggaaaccattacaactctgtgtattttgtttcattaatgtaattacataccatctcttccacacacaccccagaatattatacatttttattttgcccaagcctgtttcagtcatcagtttgtagtcttttacttccacttgtaacttgataactgagtagaacaggggtttgctagagtatatttccctgtgcttctttaggtagttgactatgctattaagataacagtatttgcttactgataacttgagaaacagtcattttcttggtctgtgctaaattgcatctcttccagtggcagcttatttctttaacttttttgacatattaagattttaatcatggtaatactgaaattgtttcaaatttgaaagagcgaacctcagtaacttcaatgaaacaaatgggtttgtgatttctagccatgttaaatgaacacacaattaaaaggaaaaccattagtggtgcaaagagccctgtgctggaaatctcaaagtcttgctctgccacttttaggggccactgtagtaataataataatcaccctgtctacttcacagggttgttataaaagttgtcaatgataaaatggatataagtgagttttttaatgtgcagatcctttatatatttaaaagggatgttatattttacccactatatacatagaaaaatcatgcccagttatgacttccaataagaatttcaaccaaatagaatctctatatgtggatgtagtgcttgaggtctgggtcactagatggataaaaaccaagtgtacatttttttatattctaccaccagtcctgagcacagcactttgcctcagaaggttctgattcaccaagacttactacatgggaatagactgatttagctcaggagctccttttaatgcaaatatttattttgcttgctgagaacaaaggattacagtgccaataactcaagaaaaggagcaggcaagccaggtctgtagagagaaaatgaactggaaaataaagtaattctggggtgagtttgatctgcactttaattcaagtctcagaaccacgtgacatatagtgatcaaaatatactctcaattgcatattaggccttcctttggggacctgggctatttattcagcactgtcccaaattaatagctaaatgactgagcctcaaatttgccgagcccgtgtaatattggtataaatttggcaaggaaagcaaatgagaaggcaggcaaaggggtgggtgaggggaagcttgctgaagctcagtatctcaaagtgagttgtggatgcgtgtttaacactataaagaaccagtccattcttacccatgagttttattgctttctgggacctctaacccaggaccacccctgattcaccaacttctccttcttctcctctttaaatattatagttcattgtgatatgtttttcctgtatctgctctatcatgtgacctcctttcgcctgggagggcagattttctccttatctcttccatccatgtctgttcttagctaagagttccagcctcagtacagctggattaccctttggacagaagggcagacaacctcaaggtcagcagcaacagaagttgggcctagtagtcagatcacaagtgagtgtggctattcatgagaatagggtggtggtggcatttatcctgcttcccctccataaataaacctggtaattttatttttaatgttacaaaaaaagttgatgctacattaaatgttttaccctcatccattatcataaatctcatactggaggtgtgatctctcttcttgtttctttaattgaaagtaccaatgaatcgaggcctggtggatgatgcctttagagttttttgttttgttttgtttttgttttcttgaatcattgaaacttgtcatttttatctagactcttccacaaatggcaaagtcacttatctgcagaattcccagaatcttcttttgcctttgtgcacctgctaattaccccctctgaactgaatttgaaaaaattaattaaaataaccgaatcacccatgtttttgttcttgcagggtttggtgagttatgtggattaaaagaacagactatcctctctctttttttgtctttcttctccctgtccaatactgaggaagaagagggagaagggggtaaagatacataaggcttaactacccagggttatgaaaacagtttgcaaagtcttcctgtttgcttcccttttggtttttcttagtccctgtaggaaaaagtttacccctctgtgtgcgagtgtgtgtgtgtgtgtgtgtaagtagttgagtgaaaaagaatgagactgacttaaggagagtcaatatcgcatatgaatcaaaagccaacatttagctattagatagatctcagtgaaaggatatgttcaagctaagttgattaagtttattaaacttatttattaagcttgactaagcttattaaaacttctgctaggttgaagccattagtaaccatctgtagaagataacagccatgagtttcacaaatacagcagcagtgtctgctagaattgtgctgtgagccacgaatgcaaaccacatatgcaattttcaaattttctagtagctaccaaaaaggtaaaagaaaaagatgaaattaattttaataatgtatttgacttagccttatatatccaaaatgatagcatttcaatatgcaatcaatataaaaacatgaatgagctattttacatttttgtactgagtcttcaaactctagtgtgtattttatacttactatacatctccagtctcgaagtagccacatttcaagtgtataagagctgcatgtgagttggctattgtattggacagtcccattcctgtttcctagtattgataaagtcttcctaccttccttcgttgttatgggagaaaatgtaaacagaacctgcctattacacgagagctgcaatatttccccaaatgcagcccagcagtaccatgagctgccctgtggaaaaatttaatctgtgattaaataagttaggaaagttttattattttacccccttttgaagattacatggtacattaacatattaaagattgagtaaactctcctgggtaaaaaaacctgtttgacgttgtttagttgttgagttctgtgtctataagaatcctagaaattgccacaagtgtctctccataagaaaaactttgtgttttcctctctttctccactccttttggggcccatttctatttatctttgtattcagaatcacccgagagccacaatatctcttttgttctagaacaaccacctcctaaattgaaaccaacagatggctttaaagtcttgcacttggacatagatcttcagaaagtaccaaaatatataccttcctcttattctttcagaaacggtgaacactctaaaaagatgtgggggtgtggtgggggatatgtgaatgtgtatatgtgtaaacaccaaatacatacagtttcttaagtagagtaatgcaattcttgctgatgttttatttttatttttatttttttatttttttttttttttgagacggagtctcgctctgtcgcccaggctggagtgcagtggcgggatctcggctcgctgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaatatttttatattttgtgtgtggtgacaatgtacatgctttaatgtgtactgttctagtaatatgtatgaagtagctgtgacatagcagtcagttttaaagatacagactataattgactactgtcaatctttaacaagtgatctttttgcaacttggttttagtggggtctctgacgttgtccccacaagtttcattttaaaatctatgcttaagtggcagttaccaatataattaattctgctgctgaatttggttcatattgaatgtggtaacccttatatgtggatatattcaaacatgtggattgatttagatcatccgttttgtctttgttttttaggactttgctatttcaatattaaagatgtcttttgaatactgtagcagcagtagaatccctatgttcttgaaaatgcaaaatgtaacatgagttgcacatagactctctagcagtagaaatggaatattctaagtgcagaagtttggttttagaatctgttaaggaaggacggcccaatctttgaaaaggtacagctttctcaactttgaacatctgggggaactcttcttggaagtctgaattttaatatctttaatccaatggctctaaattaacaaacattaaaaaatggatttcgtagaatcaaattattagggggagcactttgcaaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtacaaagaaatactctgtcaatatagtataactgcttatttcaaattgtatctaggaatgaataactactattatttaaagtactactgaattttgaggaactgatcaaagaattagtattattaataaaattgtactatttgcaatatatttgccttggcacaaatgcagagttaaaaacataaaattataaaaaaaaataatagtgattggttgttactactttaaaatcctactaatttccattagcactaaatcaaacagcacttatctgttgtatacaagtaaaattttgaaagactcggacacaaaatgaaaggctttttaaaaatgtctttgccataacaggttatatgacctcttgctaattgttatatttccttaggggcactttgaggctctttcaaagacatctgcagcaattaggtctaaatttagagtagaatattttgccagatattttactatatcacaaaatgtcatactactgtattttataataaaaccaaattctcaagtattctggtatgttacatattaatataccaaaacatcactttctataagtctattattatgtacataatatttttaaaaataatgggtattttggtcctagtgaaaaagtataatgcaatacatgacattaatctttagtcaaaacccattgaggtgtctgacagggaaattagcaatcataagctataagatatatattattttcaaggacaaaatggcaaatgataatacagaaagacgtgatcactggagcaagttagctggtgtgcagactaagaaggatcaacttgcaaatgctcatcagaatttagcttttgttattggttgttctgcaggggatagtactagtcagttgatattgcttccctttcatgtgggagtttgctcacagcccactgcatggtataatgaaatctctataagcaagatagagtcagaagcttagagatgcactttatggtttttacaactgctgttacaatgttctaaacactgtgatctttccaaatgtgttttctgtattcgttttgtactgtagaaaataattcgctataaactggactttatagtgtttaaagcgatgttatttattggcttattgcccctccttataatacatttatgtacagtacacttaatgtaaaacctgtgataatcctttgccttaaaataaaatctaatgctaaatattcagtgtcctgattaataattctaagctaccaatttttcctttaaagctaaccatgatgtcaagtaaaacattacacaaatactctgtggagtgttgctgctgattctgtatttgtggcagtgtatgtatcttggcccaggacatggtggccttctgggttctataaatagacattagtaatccttttagggaaagggcctgctacctctcagctgctggctgaatctgccccttaactcataaatggattttctcatgccacataaaaaacagaaaaacagcccaccacattctctccctgtacctcttttttggtttgattccttttgaatctttatattctatttgtgtttacattattttcctaaatagaaaaatgccagagatgcctgaagattgaaatcacccaatttcaacaggggaagagatcttataattatttaagtctaatccctttatggaacctgagtttcagaaagatttagtgacttgatcgaggtctgagggacgggggtggactgagtacatcctgatatcaagaagatggtggaaagttcaatgggctaaaaggagttgtgttagtcttggtattggcacaccaataagcagaggtctgtcttggaataaaaaaaactacttccttattaggccctgatctttgccctgaattacttacagttacagaggaatatattttgtaggcagtttttctgggaggtaaggacaggttcctagagacgatctttgacgccttttcaccactggaagcaatgcttcagaccactgtatttggaagacaaagggacatgctcacatggcacagtgaaaagtgaaatcttttcccacttggtggtgggtgcatgacaatatacttgcactttgaaaagcctctgtgtggtctggttatttttaaaaggccagaaatgctggccctttgaagaatcacgcgtttcctcggcccagaaaatagactgggctagaaaggcgcccggactccaattctgggcccgggtggttgcagtttttcaaagggatgtgaacggtttcccaagataggacccaagggactctaggacccagaggctgcgcgcgacgcccgcagggcgaactgcatccttttgagctcccgctccatggcctgagccgtcgtagggcgcgggttcgcggcccgccaggggacggtcaccacagagacgcagccggcactggcgagcgagcgagcaggcggcgcacggagcgcgtgggcgtgtcccggcggggctgcgcagctcgccccaccccaccccaccccagccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgcgtgcagaagcccagagccagccccaggccgcagcctcggtcctgtagcctgatctccccacctgctcgagtggagggaggcggttttcctgtggagacaggtggctgagccccaagccggtccgccatgcccctcagccccattattccagtcaggaacgcgacgaatcatggcataatggttataaagttggggcacactgaattcctgttaggttccgtcaaatgaaatagccaacattcaactgaaattgaccaacaaaaatggcagtttcttgtggttcaacctcattaaagacattggtttctctggggtcaagtaggctctgacaggattggcttgtgttgtcacaaacccttgggaagtgtgttctaagctgtggttacggggacagcatgtacaggtgatttaattttaatttatcaaacacatggagcttactgtgtgccaagcactgttctaaaagctttaacagtatttaattctcatagggaagtcaagaaatccatgcaccattcttttctcttggtggcgttacgaatattatgggatatggaaacatatggggttctagaaatgtcttccggccctggcaaacttataaacgtagccattaaagctggtgcacaatgcaccatgaaaacaaaacttgctgtgtgttaagtaaagaaaaactgttggtgacatttctggaaattaatttttattaacacaaagcaagtagaaatacatggtaataaaacagactggcttatctaaggagtttaaaatgtgttgttttagtacctttcatcactataggaaaagcaaaacaaaggccgtccatttggattagaaataagtttataatactgaattttagacataggcgacagaggaatttgaagagatggaaaggccagagagacacctcagctgccagaaaattcagctagccctaccaggaaatctctctctctctctctctctttctctctctctcttacacacacacacacacacacacacacacacacgcacacacacacattgaggagcaagataaattttacaaagttataatttttttttttttgagacaaggtcttgctttatcagccaggctggagtgcagtagcaagatcatagctcattgcatcctccacctcctgggcacaagtgatactcctgcctcagtctccagagtagctaggactgcaggcaagcgccatcatgcctggctaattttcttttttctttctttttttttgtattttttgtagagacagagtctccctatgttgcccaggctggtctcgagctcttgagttccagtgatcctcctgtctgggcctcctaaagttctctctatgttgcccagtatggtctggaactcctgagctgaaatgatcctcctgcccaggcctcccaaagtgctggaattacaggcatgagctaccacgcctggccataaaatttttgcacctcatattaaagaaaactgttccagctgacacacaaactactgacttgtagtttgcacacagtcacagcaaacttggtgaacaaatttctcagcctccagaagctgcagaatcctagaaaggaaaataaacaggtacactggcaggagtgggaggttgctgctgacttcttgatagctggggaagagtctggggaaaaagaaagggagggaggggaattttaaaagtcctgcaacctggagccatttagtgaggagagagttagtccttcctagccaggtaagccctgtggtctggactgtattcttgctcagtaaaataagtgtgatctgactttgggcagggcacttatcatttctttctttctttctttctttctttctttctttttttttttttttttttgagacggagtcttgctctgtcgcccaggctggagtgcagtggcgcgatctcagctcactgcaagctccgcttcccaggttcacgccattcttctgcctcagcctcctgagtagctgggactacaggcgcccgccaccacgcccggctaattttatttttttgtatttttagtagagacggggtttcaccgtgccagccaggatggtctcaatctcttgacctcgtgatccgcctgcctcggcctcccaaagtgctgggaccacaagcgtgagccaccgtgcccggccttatcatttcttaacattatctgtgagaagaaaacagataatgtttaagtggagtaacaggaaaaaggggaactgacatttctcaaaagcttcttgtgctagatggtttgatatgtacttacatgcctcaattcattgaatcctcaccatgacatagacgtaattgtccccattttgtaggtgaagaaaatgaggcctcagactatgttctcaagcctccttaaaaagagctaattatattccctatgctcagtggaagaaagcagaggactgtgtagtacattctattagtagttccattttaaattaagaaaaagtttggtcatcttggcaatccaataaatgataataccctatcattgctgccatttaaagtgtttctaaacacgaagagtaacccaagacaaagctaatgacataatatatataaaaacaggatgacaagtataaacctgaactcaaggaaacataccaagatgttaagaataataatttctgaatagtggggttatgagtgataatatcctggaaaatatataaaactatataataaaacaattatctacttttctatatttttcagtttttaccataaaaatattttaactttattaaggaaagaaaacttttggtgctttgaagagataacttctcagctatatataaagtttcaacactataaaaagacctatttccagaaagttctgaatgggccattgtcttcttggagcaaaaacaaaataaaagataaaaaacaaaacaacaggcaaaccccttccatcaacaaggagtcactgattctaatgcagctgatttatttcaaggagttattggacccatgaccttagagctgagatacaaaatgtggttccaagtctcttagcttccagattaaaagaaaagcagtttgttcttgtgtattagcctgacttaatatcttactggaatttcttcctgctgactgtttgattctgttttaactctaagacatcagctttacataaagataaaaattatttccctcaaacaaaggagaggcatggtgattcttacccccttccttatggattggatttaataatatttctaaattgttttttgacagtttaactcttcttgcctttggatgagtactagccaaactcgtgtttttgctaggtagatgctgcgtttgagttcatgcagcacgatggcccagttaaactgcaatacattacactaatgattctggactaaatactactaactaggctttgctccttctttcctttagggaggcatagggagagcaccatatttcatttgtatcagtcttgtatttaaaatggtagttacagtttttatgattgttttcacattaagcctgagtttgaatgatacgaactttggataatgccttgaatttatttataattttaaggaaaatcttattgcgcattataatagatactctagcaaaccagagcagggaaaagatctcttacctaaaacacaaaaacattttaaaaattctgtttatcattcttttacatttatgctaatttttataaattaattgggaggaataaatataaatgagttacaatttcaaggaattcccctcatttcttttttattactggtatagtgaggaaaaaatggtacatgaaaaatctgagcttataaaataaaggctaagaagttcccgaaacctttccagaacattgcaaaatgattcaccatagtatatctttctatattaaactttataaagaatttaaaatattaatagtctacatttgaagagaatttttttttcatttgcaaggtgcttttacatacagtatttaatttcatccatggtaaaaccctgtgagttaactgtcattatcttatttttacagtccaggaattgaggttcagtgagattaagcaagtggcttttcaaaggttttgcagcattttctatttaaccaatttgggttttgtgtaggcttacagagcatgtgtgtcatgtgaagataatgtggcttattggaaattatagtatttctttggaaaaagtattttaattagggtctctggtaccacagattatttatgctcacatcagcatgcatgatttcagctaaggaataagctccttctgctatgatacttgaaaagtgggatatatgatgcttgaaaatgggataaagtaaaaaataaggatcaacctactgattatctacattggggttagcaaactgtaccccacaggcctaatacccccatcacctgttttagtaggtaaagtcttattggaacacagcgttgctcactggtttatgtactggctacaactgctttcacattgcagagacagacttgagcagttgcaacagagaccatggcgtgtgaatcataaaatatttacttttttataaatacttcacagaaaatttgctgtcccttggtgtagatgatactgaaaaactaccttgagtattcagttttgataaaagtatctaatttctggctttatttagacctctcaagcaacaaacaaataaaaaaccaaaaaataagaacagattttgagtaattagatgagtcttgcagaattccaagaatagtagtttgtttcttatcagttttcctaaccaacagtggcaggaggtcttggggccttttacaaatgtattaaacacctatgactacatgtaaaactctatgctaatacaaatgtatcacctgggaaaaaacagtggcttacaagaggttccgcctgagctttaggaccttctttcatttccatcaactgatcatggaagttttactttgtctacaattctgcagaaagcttccagtttcatatagccccttccttcgcatcaagaaaattactttctcctctgaaccctcatttcgttcattcagttcttagcatatgctggtatttaatttgtatgttttagtctttcaaaactctaagcttgattttattatgcaagtaaaacattttttgaaatgacagaagagcagaaaacagatttgcacaatgaggaaaataaaagctctcatttgactgctcagacagaacaattcctaatgtttttgttgtatatctttactaatatttttataatggtatgctagtaaactgttggggaaaacaagccctgattttcagtgtttgctgatttctcaaatgcgtatattctcatcatgattgatcaagctaccagttgtttaacaactggctcacaaaattcctattttaacagtctgctctcttgagtcagtatgagccagctcaaacatttcactgtttatatgtatgtgtgggtatgtgtgtgtaatctgtatatattttttatatatgtgattttctttttacaaaaaatggaatttaaaatatatgattctattgtaatttgcttctttcacataccaaatatggtaaaaatacgtagcctggtcaacatagtgagactgtttcctcacaaaaaataaaattagctgggcacagtggcatgcatctggagtcccagctacttaggaggctcaggagtgagggtcccttgaggccagcagttggaggctgcagtgagctatgatcacaccactgccctccaacgttggtgagagagtgagactgtcttttaaaaaaaatttatatattggtatatgtacttctataccattgatgttaaggaatgtataatgtttcattgaattgatatattagggtttatttaattattctttcatttttgggacctttagagtattcccagcattttgctattatacataatgctatgatttaaattgttgcaatacgttttcttctaagtgagatcatacgtgataacatgtcataactaaaagtgctatataaatattaattttcgtttattattattattattgtgcatatgtcccactatcccatttagattgtgagtgcccccaaatgaggcaggggtatccagctgtctgcattccccacagcacttagtaaaccacacccgcattcatctcatatttgagaataaagatgattatcagtttattctgtttttgttttgttttagtttgtttttttgagacagagtctcgctctgtcacccaggctggagtgcagtggcgcaatcttcgcctcttgtgttcaagcaattctcctgcctcagcctcccgagtaggtgagactacaagggtgcaccaccatgcctggctaattttttaatttttagtagagatgtggtttcaccatgttggccagactgatctcaaactcctgacctcaggtgatccgcctgcctcagcctcccaaagtgctgggattacaggcgtgagccactgcccccggccagttcattctgttttctaatctttgatgtgatcagtggtccaacagtgtaaagttgctaggcctcatacagtcctcagtcattaatttgagttttccttcagagaaaattcaattggacgtgcttgggattgaactcatggcctgaacttcattgacattatttccaactgaaaaaactggtctgtgtggttttacattgttttcatgtaatatattaaagtgttcttgaccccatgggacaaaatgtcgtacacaaatcaacccccccccacacacacacccacacacaccatacaccttctttctcctagcaacaaatgaacaatggtattaatcacaaaatatgtccactttgagctcaccagaaaggttcctgcatttcctctcttacatcaagctttattttattatttcaaattataaatacattccagttgccgtagtcacctcaggatgagagtataaagttaacattataacataaacattcaatgaaatagattaagccattaaaatcttctggcagcatcataaggttgttataaaagtgcatgttagaggagggacaaaaagtcctttaacaagttacaaacctacggccatgaatatttttcttactcctagggaaaacacatttttaaccagcattttattatgaaaattttcaaacacacagaagacaagtttaaggaattctatagtgaacacccaagtactcaccacctagattctacaattaacattttgtttcacatatttatccatctatcaattcgtgtgtgtgtgtgtgtgtgtgtgtgtatgtacttcaaagttaatcacagacatcagtattcttcccacttcagcatccatatttttacctagagaggaaatccaaattttaaaagccaggtattctctcagtctggaaaagtcactgattaagtctgggactgactttagtcccgccctgtaaggacttatgaaaacagagataggtaacatgttgtggtctcccagtgaaatgctagatggcaagctgccctgtgctggaggatttccgagccatagcttctgctttaactggggtggtttggggcatcttttggatgtggaacacacacacgtgtgtgcgtgcatgcatgcatgcagtcacactatataatcaccatttttcacagcaatatgacaaagtgggtattatatctgctttatagtggagggaatgtgctggggtggggatagtaggtgactcggctatggctacacagctagtatgtgtcaggaagggaaactgcacattttttctgtggctctggagccggaaccactttccattctctaagagatttccttgcttcagtggcctttggtattacctcttcatttggttctcattcaattcccattggcctgctggaaagcatcaagaggactgcatactgagaactggtccttggagtagttgatttagaagagtgactatagttcagagtagccaagtcaaggctttaagaatcaggctaaaggtaagtaggatgagcatggaaagtcagaatcctgtctgtctctaattattatgatttcctgatttgttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtacgtgtattttttatttctgcctgcatttggggatcaaaatgagaagcaaaatatgcagtttattttgtttcaaaggaaatttgttcttaagtgcacttaattctgaatctgtgttctagttactatgctcaaaactcaattaaaataacaacgtttattttgcttatgactctgcattctaggcagggctcaaaagggttacctaatctgtgatccactgtggatcagctagggtggctcaaaggtagggggctagaatctattcaaggccccttcactcacatgtcttgttgttcacatgttttgatattggctgttgctgggagtttcagatcttctccatttgatttctctgtgtgggtgagtttgggcttccttatagcatggtagctgcttccaagggtgagtgttctaagaaggagggaaggccagatggaagccacatcagcttttgtgatccaggcttgggagttgtgggacatcacttctgcttccttctcattgttgaaatacttacagagttctgcccagattcaagggagaggagagggaagcaaactctgactcttgttgtggaatggtagagttctagaagatcacctgggaccaaaaataccactgtggccatttttagaaaatacagtttaccagaggctgaaaacacagctactggaggctgcttctcttgggatttcactctgtctttcagtgctagttctaaactagttgagacagttggcttaacaactttgtggtgaataatggaacaaggccactttcctgtcttcttagacttgtaataggtatatcagtttataagtcaagacaatattctacctttgggctattctcacatcatcaaattaagagcagattttggttaagttaaaaaaaaaaaacactatttgcatcagagtcaagattttaatgaaaagcctacaaatgagaagtggaaacaaccccctcccaagtattaatattatgggtaaacgaaaaccattatggtaagttttattatcggtatacaaaatgatttaaaagccgtaagttgaaaaaatacatgtttaagaaaacattgaagataagaaagactcttatttattttacttcactcagttttatcctctttctgcctatgttttagactggctagtaataattcatgtcagagtcacaggatacttacatgttagagccatctcccttatccaggttgcctgattatgattcttaaaatatgagtcaggatcttaagtagagatcttgaaccttaatggatcaacatttatatgtaaatactttccgcaacacctggtagggagtaaaagctcaataaatatagcaacatccgtgttctctaaggaattataactggaatgggtcttgaccaagctgcatgccactatactctttttcctagtttattgtttttccaagtggcagggatacagcaagaaatcagatgtgatgatagcctatttgatttttagaggtagatccaatttttttcctcaagtttttttagtgaagattgtctcacagttgaagggttggcaaactacatcccatgggcctaatctgggcactgcccgtttttgtcaataaagttctattggaatgcagccctgctctttcatttatgtattgtctgtgactgttttgggactaaaacaacagagtcgagtagttgcaataaacataatgtggcccacaaagcctaaaatatttactaactttttacaaagaaagtttgccaacccttgttataatttttcagacataattctgttcaggaaaaataaaatctgtcttgtaaaatgtcagtgtcacaagggatatctgaaatgtcccaaaagaacttggaaaaacagaagtcctctgagagttaaatgataaatcaaatagatatggaaaaaggaagtgggcatggtcttgttaaaaagatagatggctgccatttatgcaggtcttgactaaccccaatcactgccttaacatatataaggagggaatatctcacccggaaagggtaagacccttatgaatggagcatggtctagggtgtgccacaaaggcaaatgttggtagtgtctgtcatgtggttagaaatgcatttggtgcaaggaagaaacacctaactgtaaagttaacctagagtttatttttcttatctaactggaaattggaagtagacagttgctgacagtatttcagctgctcaatagtggcaaagttgatgtccctgccaatccattggccttttgcttgggttgctactgcatttccaaccatcatagctacattcaaaataggaagaagggctgaagaaggaagggtagatatatttctctttttattaatgaatatagctttttcataaatttccctaatagactttactttgtcttcctccttttattaaaaactatagcttttccagaaatctccctaacagaaatgactttaggtctctgaccagaactgatcagtcatttagcttaaagggatgctaggaaagccaggtctaggaatgtttgccaccaatggcttagactaatattcctcaaacttccctgatgatgatgattagagttacctgggggcttgttaaatatatagattaccaggattcatctctggaaattgtgatttgctgtgtctgggatgggagccaaggttatgtgttttctttttatttcccttttgttatttaaacaagggctccaggtgattttattatcagcaaagtttgagaacattggattagactagtcatggcctgcgtgtggttgggcccattgccacccataacaaaaccatgttctcttaagatagtgagaggaatggaaaatgaataggcaactgacagtgtctgccacatcatctaaatgcagtccagatgaatagaaatgtgtccctcttgacagaaggacatagagtccatcacaacatgaccctattcagcattcaaattctgtaactctctcctctctctctgattctgtgctcattgagcaaacattgatggatttggcattagcagagtttgccatgagggagagaagggagagccagctacatggtcactggagagttattgtttttcttcattgcaatataattcatataacataaatttcactactttgggtgtacaattcagtaggtttcaatatattgacaatgttatacaatcaccaccactgtctagttttagaacattttcatcacaccaaaaataagtcccctattcattaacagtcactcttcatttcccctgcccctagcccctggcagcctactaatctacttcctgtctctatggatttgactattatgaatctttcatatcagtggaatcatatgctattgggaagttttctttctcatagtcagtgaataacggacactgtgtctgtgagcttcagtcttgggtgaatttgggcatcctgagattccctgagtctaatcagttctcagcaagggcttgctcaagtctccagatcttggaggatgggttgggttgaagcctaagtgagcataccaatgttactgtgctttgtgaaggcccctgcagcctgccatttggcttgcctggccctcacagtgcccttctctattctactcaaggtggtaatgttggtagtaaaaatggctgtttcatgaacccttgatttgtgccaggcactgtgataggcatccttgtgtttcattttcagtgtccctgaggtagataatattatctccatcttagtaaagagggaaattgagccagacacagtggctcacacctgtgatcctagcactttaggaagccaaggtgggcaaatcgcttgaccccaggagtttgagaccaccctgagcaacatggcgagaccccatctctacaaaaaatacaaaaattagcagggagtggtggtgcatgcctgtggtcccagctacttgggaggataaggcgggaggattgcttgagcctgggaggaccttgcctcaaaaaaaaaaaaaaaaaaaaaaaaaagaggaggaaaattgtacttatagtcagatagaggagccagaatttgaggttagatttgtgtgactttatttatggactcaatgagtatttcttgggtatgttctgtgtttcagaccctgtgctggtctctgaggataaagtggtgaataaggtaggcaggccccaatcatcttcaaataggatatataaacatcacacaaattattaatcaaatgcatattttatttaaggtaaatcctgcaaagtgaaagataagtagcctctctgagggtatattgggggttgtctaaccgagtctgggaaatgaggcaaatgtttccaaaacttagatttaaactgaaaactgctagatgaagaaaagaagccaggtgaagaaaaatcaggaaagagcatcccaggatttcaagctttattccagaggcaatgggaaggcactgatgagttttaagcaacaagtgtcatgatcaaatttagttttagaaactgattactctgcaaaatgtatttgaagagagtgaagaaacaaatggagaggctaggaagtgggctactatagttgtcaaggtgagaataatggcctggactggaatagtcagagtggattattggagcaatattaagaatgcgtaagtggaacaatgtgatgattgattggatatgaaggtgaggcagtgagagatgtcaagaataattcccagttcctgatatggactgctgtagccatggatctccatttgtcttggtagtgacaggtttgcgaggtatattttactttcagttccagacttaaagaaatgaatacattttaaagattctatttaactcatgagagaacaagcagatgttctcttcggaccagcttataagataacccaaaggacagacataggaatattgactagagatatcaaaatgaatatgtaaatggaagtaaaactggttttattacagcatgggggggtgacatttgaacctctactgtacaagacattgagcatgtctgttagtgacttatagcttacagaagaatgtaaatgagctcactggcaatacaaagctagaatcagagaacctggattggtatactgaagacaggacaatgttttgattgaaacacattttttttgttgttgctagaatgtttaagtcaagtacaaagttagactttcctcaaaaagacggtccagttattagggtgagcaggttcctgtcagaaacattttgaggccgggcttgatcagggctcagtgaacaccaataatatcacaaagttgaggttgtcttgaaggcagctccctgaccaaggagggcctggagcacagtgggcgggaataagcactggtacctggagaggctcaggctagtgggaaaatcgacgagggctgatcaaaacaaaactcaccaagaccatgtgaaggcaaaaaggagccttagaaaggagattcttccctgctccacaaaagcctagctgcagtttcctgttagccacatggacggctttctgcgaggtcagtatgcccagtgcctgagctcatccacacctgttttcctggttgttattctctagtatctgatggccaacatcctggagcaggcaggcaagaaggcccagaacaattgcagggtgcgcatcacaccagaacacatagagagggccatgcacaaggataagcagctcagatgcctcttggaggatgtacccaccatcaggttgatgaggtgccccagcccgagaaggagggatgcttgggtctgagaacctggcaggacttcatcaacaatttcatccagcctcaaaaattcccatagatgagagaccccaggctgctgccatcagcccatgctattaaagtctttaatgacagtgcccctgacttctctcaggttctctcattttgggttggaggtgtccttgagacatccaggagaagctatcccatagagagctgaatgggtggaaggtgttgccagtgtggggtgtttgaatcagtgattttagaaggggcagtttccagtggttggtgagagcactggccctggcgggaggagctgactggggataaagatatagagacttcctcattggctttgaactggaaggccttgtgaggccaggtagttgctgggagcctcctaggcttgataaattcctaacctgatgctgggacctagggtggagctgcagactctgactgaggtgcgggaggctttattcagaatagcaaaggtctgaagtcagagggcagtagccacagggatgggtggagagggggcacactgcatactagctggcatgaacttcatgggacaggctttacatggagattgaggagtgatggggaaaacataaggaaaaaatgcaaaaaaaaaagttatggtcatgttattttatttatttatttgtaccctgcctcattccaaaagaggacttgagacagggattagtaactggtactatgacacattgtttggaatatattcttctgtcctcttgtggacactgttaaattaagtagtaacattatataaaagctctctggcctaggacatgcaatccaatcagttcttaatggttacaaaatattacaaaacttatttgtaaatgtattccattataaacacaattatcaatcgcattcccagaaaaaataatctgtgtatgatcatgtatttcatagaacagcatagagttatcaatggccaaaaacaggttcaaaaggtatagaaataacctatgtaattctgtcttgagtgatggcctctaaagcatgtactgtacttttaaaaacttgtgctctgtactgtttaaaaaaggtgtcacatcaagtgttgtagcaatctgtccccttgcctgtgaatgtccatattttaggttttcacctgttccttggatcctctgtggccacattctgctgcctgttggccagatgctgcccagccagattcaataacagatcagacaacctgggtttgagatcctagttcaccactttctggccatgtgatcttggactttcatttactcctgctgggcaggtttgctcatgtgtaaaatagcagagagtccctctatctttagttttcccaaagattgagtccactttggatatgcacagtgtggcccttaataagcagctgcatctgtctcctcccctaaccccagacacgcaggcaggcttccccagggtacatctgggtctggttctcaggttactgttgggcacttgggccactggctgtgagagtgacatcctgctgagccctatggagagacaggagagtgcccagcagaggaaggagacagcggaagagggacacgagccaggcagtccccactctggtgtccctttttctcctcctgccttgtgactcgccctctctctgcctctgtctaagcagaaggacccagcttggcctttggctaattcacaggagtgtcctgagaatgaaggaaatagcggttatgtgtttaaaaactgggctgtgagaaacccatgtcctggacacaaagatgtttcacttcggccaggggagggggtgctgctgttgccatgaagtgatgagctgaaggagactccccacctgaagctgctggagagaggcctgcttgcagctcaaatgcacagaagaggaagcgagcagctgggctaaggctgggagtgctccacggcgctccctaaggaatcatgcagtggtggggtgggcagcttgacaatgaggtgcctggaaatatgaggttcagtggacatgatatggcaagaaagacttctgggatttagacaagcacatcttccacatggccctaaggacaaccctgacagtactaatctctaatatattatttcctaaagcgcagtctacaaagtggcatcttacaactcaatctggatggcagataggtttgctagttctaagcagacatcttaaaagaaaattaatgagctggtagcatttgaaaatcaataacattttacctgaaagtctggatttctggctctcttgagaagtaaaaaggagggtacacatgattacagtcacatagagatgactagctactgcaccatgaagactgggcctctggtttgccacattccttccacactcttccctataaagtcccatatctgattcacttcattaatttatagtagttgtctgattaatagagatacttgagtttgttactctcactacaagttaattctaagttcacagtactcagaacaatcaatctcatttaatgaagtagtatattgtgcattgcttctcaaaatatcattggggtaggaccagtagtagcaaacttccttgtttttcttgttccagtaaattgtgaactgatatgtggttgtattactagtatgccactcatatttgacttgtcatttgagtttaacaactgcactggtatataccttgttcaaaaagtgagcccactaatttaaatgttgtggctaaatcagatgctatacagattcctaaatgccagctctcaatgtccatacttatcataactgactggtaacagatatttcattgtaccagtcctcaaactttttagatttagatttagattttaaatctaatgaaaagcagtaaacaggacctacagttggtattgtttctccttcagagtcttcatgaaaacagatttatccttcttatatttaggactttagcataatactggtgaaaatgttgctgaactacttctgttaaagcaaaagatattaaggaaaccaattagcatcagtggggcatgttagatgcggcagatgtgagattgttgagttctgaaatgtaggataaaaagaattcaccaaggcaactgtgaaagggagtcttcatgaaaggagaggcagaactgggttctggtctcctacagtgtagtttacttggggacccatcagtttccagtgagaaaaatggaaaaattatttcaaaactcagctagagatgtgtacttatgactgtgctcttttcctaacaaaatagttctatggaaaatgggtaaatagggttcagagtacagggtctccattttacagctgaggccactgaggcccagtgatagtaatcagctcttataaagtcacatggtgagtgggcagcacagtagaatgatggcctggccttccttacctgttattggggctctttcctctattgtatcctgaaaaaggggtctcaaaagagaaagtgtttaatgttctcctctgagaaaaagaagctaaagtcttcaataccaaggtgttagggtctcttggatttcttgggaagcactcaataactcactcccaagaatattcacttgtgctttatttgggtaaggccagacaggtcaggagaaaagtgctgattttatagtataggtctttggactttgcaaacttagattttgttccactggacattgtattaaactgtgttatgaacacaaatttgtctcagttaaggtgttctggaaattctgactctgtccactaaccattatcttaaatgtggtgatgtgatgtcatgagaagcctgtgttcaggagcctagtctttgaagtacctgaggtagtgacgtttttcatggtgctctaagacaatccttctttgctgaagacaaaatctccctcctgtagctgattgtagggtcattagggaaacatcagtgtaaataaaaaactatctggagagccaggcatgctggctcatgcctgtaatcccagcaacttagaaggttgaggcaagaggaacttttgaggccaggagttcaagaccaccctgggcaacatagtgagacctccgtctctacaaaaatattttaaaaattagctggatgtggtggtatataactgtagtctcagctacatgggaagctgagctgggagaatctcttgagccaaggagttctgagctgcagtgagctacgattgcaccactgcactctagcctgggccacaaaatgagaccacaattcttaaaaaaaaaagtatcagccgggcgtggtggctcacgcctgtaatcccagcactttgggaggccaaggcaggtggatagcctgaggtcaggagttcaagaccagcttgaccaacatgatgaaaccctgtctctactaaaaatacaaaattagctgggcttggtggtgcatgcctgtaatctcagctactcgggaggctgaggcaggagaatcgcttgaaccctggaggtggaggtggcagtgggccgaggtcacgccattgcactccagcctgggcaacaagaatgaaactccgtctcaaaagaaaaaaagtatctggagatgatagacacttaaagtgcctgtggttcacttatgacttgtgataaagtgaaaagtctagtggaagtacataacaaacataatacaactgaagaagaaattgtgacatacaaaataagataataaagccaatgtaaaaaagttttgaacaaaacatatgtaagcataatgattaatcctattttgaagtaagtctacagtagattctagacatctgtattttactatacctccataaaaagatttgatgtgtatcctcaatttaaaaagccatgagggaagatgcttcataaaacttaaaagagaagccaggcgtggtagctcacgcctgtaatcccagcactttggggggccaaggcgggcggatcacgaggtcaggagatcaagaccatcctggctaacatggtgaaaccccgtctctactaaaaatacaaaaaaaaaaaaattagccgggcgtggtggcgggcgcctgtagtcccagctacttgggaggctgaggcaggagaatggcgtgaacccgggaggtggagcttgcagtgagccgagctcgcgccactggactccagcctgggtgaaagagcgagactctgtctcaaaaaaaaaaaaaataacttaaaagagaaagttgtgactagatagttttagaaatctactgaaatgatgactgttaacactataattttattgcctaatattatgaaggaaagcaccagcaggactatgatcattagaaacatactatggacagtgggggcactgacaaatctctaggaacttctcatacaatctagaacttctgaaatatttatactaataatatatttcatattcagatttaatctagggaaggctgagtacctcttttctttttttctttttctttttctttctttctttctttctttttttttttgagacagggtctcactctgtcacccaggatggagtgcagtggtgcaatcatggctcaccgtagcctcaaactcctgggctcaagccatcctccccactgagcctcccaagtaggtgggaatacaggtgcacactaccatgcctggctgatttttttttttttttgagacaggatctaacttatgttgcccaggctgaagaacacctcttttgattttatttttttccatgcaactcatcaatactaacagcaacaaagctaattttatctaatatctgtctttttataaggtgaaagaacaaatctttcctattttctaggtactctgttggaaatctcaaagataagtctaagtgtaaaagatttatagagtttcattttatttcatttaaaattttgaattttattttgaaaggcaaaattgctagaagatttgagaattaagttaggatcatgagtgactgagtacatgaatggttgtagcttggctatctattaattaaagtgacagtacaatgtttagataaacatccaaaagaccttgacacattcttaatgcaaattttttttgtttttgaagagaataatcaagggcatgataaagtcagggaaaaaaagtgttattgtggtaagatgccaaatccctacttttaggataggattacataggtaatattttaggctaaattatgaccccaaagatattcaggttctactccctgaaacctgtgtatgtcactttatatctgcaaagggaactttgcagataaagagattgaggttgggagattattgtattgtaggtcgtgcaggtgggcccaggacaaatgttctttttttttaaaattaattaattaattaattttattttattttatttttattgatcattcttgggtgtttctcgcagagggggatttggcagggtcataggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccccccttaatccatttaaccctgagtggacacagcacatgtttcagagagcacagggttgggggtaaggtcatagaccaacagcatcccaaggcagaagaatttttcttagtacagaacaaaatgaagtctcccatgtctacttctttctacacagacacagcaaccatccgatttctctatcttttccccacctttcccccttttctattccacaaaaccgccattgtcatcatggcccgttctcaatgagctgttgggtacacctcccagacggggtggtggccgggcagaggggctcctcacttcccagaaggggcggccgggcagaggtgacccccacctcccggacggggcggctggccgggcgggggctgaccccccacctccctcccagacggggcggctggcctggcgggggctgacccccacctccctcccggacggggtggctgccgggcggagatgctcctcacttcccagacggggtggctgcgggtggaggggctcctcacttctcagacagggtggctgccgggcgcaggggctcctcacttctcagacggggcggctgccgggcgcaggggctcctcacttctcagacggggcggctgccgggcggaagggctcctcacttctcagacggggcggctgccgggcggaggggctcctcacttctcagacggggcggccgggcagagatgctcctcacctctcagacggggcagcggggcagagccgctccccacatctcagacaatgggcggccgggcagagacgctcctcacttcctagatgggatggcggccgggaagaggcgctcctcacttctcagagtgggcagccaggcagaggggctcctcacatcccagatgatgggcggccaggcagagacgctcctcacttcccagatggggtggcagccgggcagaggctgcaatctcggcactttgggaggccaaggcaggcggctgggaggtggaggttgtagcaagccaagatcacgccaccgcactccagcctgggcaccattgagcactgagtgaacgagactccgtctgcaatcccggcccctcgggaggccaaggctggcggatcactcgcagttaggagctggagaccagcccggccaacacagcgaaaccccatctccaccaaaaaaatacgaaaaccagtcaggcgtggcggcgggcgcctgcaatctcaggcactcggcaggctgaggcagtagaatcaggcagggaggttgcagtgagccgagatggcagcagtacagtccagcttcggctcggcatcagagggagactgtggaaagagagggagagggagaccgtggggagagggagagggagagggcaaatgttcttataagggagaggcagcagcaggcttgatcacggaggaagaagacaatgtgaggagtgaaacaagatgctgcactgctggctttgaagatggagggaagaggcaggagccaaggaatgcagttgtagaagctggaaaaggcaagaaaatggattctctccttgatcctctggagggaacatgcccctgttgacaccttgacttcagcccagccaaactgatttcagacttctgatctccagaactgtaagacaacaaacatttgttgttttaagccactgtgtttgtggtaatatgttatggcagtcataggaaacaaatttacgccaaaagtaatcttttacaacctcttattaagaacagaccagtactccaagaaaactcattttcacagaaaaactaattctagatttgtttcaatgaaatatttgcttctaaataacccactatttacttttgacagtctcacaaataaacccatcaatactgagccagatttggcaaaatgttaacacaaaattgtgttcctttccagactctttctgcaaacctcctacaactttctttattcattcaggttttatccttcaccattcttcctcattcctatcctggaacaagtcatttttctttagaacagaaatatacttttttgcccataataaaaatttcattatcttgagattcctagtaatctcattcacatgtattaattataacttttaagcagccccttgtatttcacaaagaaaatgaaggagtagataattgtgaatttctgtcattttagcagcctagccaatctcatgaatatacttcactgagctttatccagccacatacttcccttatttaattccacagtgtggcagaaatgaacatgttcatttacagacccaaagatagagcctctttgtagcatgtacaaataacaagcaatagtgtataaatgaaaactgtacttactaataaatttttcagtattctatcttacttagaaatgatctagaaagccagtgaatggccaagatcttcagttatctaaagattttggaaatgctcttcagggtaacatactacacaacctcattactatggaactataaatttatcagaacaatgattcaagttgcttaaaaatagatttaagtttttaaattattttaaatatttaacaggagtaagtctagctcatttgatcaaaaagctgtataagtttaggagaaacatactcaagagtataaaaatatatgcttgtattaaatatgacactgataaatcagagatgtttacattaaactcaaagtcttaaactagtcttatttgccaaagagttacataaattatagaagtctgaattcttaaaatggttttgagttggtttctaggataatacattttttaaactagcacatttaaaaatcaatagtacaatttccgtattttaggaaattctagttatattcaatttatataagcagttatttttctggatatgccaatcagaatagaactcttttaatttgggagagtttataatctaatatattagtactgtgcataggtaggaaaacattacacactcgtacaatcagaggtgaggatattacagacatatagacatacagatagagagaaatagagtttgtagcttcaattcttcaatttcaggcatggatcaagagtgaacacaaaatcagaaaatctcctcagtccagattttaatagctcttttcctctcaaagggcatgaaattcttaagtgatttgagcttagaaaaataaactaacaaaaaggatgacaaaccagactttctgttgcctgtcacccaatagggactagatttctgtaaaccatggatgcacttagatctccagattgttagaccttaaaattggatttcaaaccatttctctcaataagggggagtaacttaatggctttaagtgaaccagaacaaaacagaaacacaaaatttgtagagagaggatttcaaatgagaagtcgagggtgtcaacaaagctctactggtgctctggattcacctatgagagcgaagaaaggacatgcttaggctttaactgctcatgaggtgcacttccttgtcagcaatgtttacctgactcttacaggtgaatctattggacatctcattatgacttccaaagttgttaaaatatatttttcaaaagggtaaaattatgttgctcatacagatgtgaacctgttgttgtttacttgtaaggaaatgaacagatgttatggccgggcgtggtggctcacacctgtaatctcagcactctgggaggctgaggtgggtggattacctgaggtcaggagttcgagaccagcctggctaacatggtgaaacctccgtctctactaaaaatacaaaataaataaataaattaaataaaagagaaccaacaaaggattgtttagagatatcaaaataagtatgtaattggaaacaaaacttcttgtatgacattttgagagggaagacagttgaacctgtattgaacaatgcattttgcagtatgtatcggtgacttgtcagatagcctatatcctggagttgaaaaataataagaccagcaacaacaacaggagttacatcgccccacagaatgtggaaatgccggtgcacaggcctgagtgccaccgattctttaggggtgggacagtcagtctaattgacatgtcccaattcaagaagaattgctgatgcctgggttccagagcctggcaggggtcctcacagcctcatccttcggcaaaaccactcagttgaggaagccccatactgttgccatcagcaaattctctcaaaaagtttaaatccatggatgtgtttctgactcctctcagtttctgtcatttttagttggaggtgtctgtggggcatctaaaagaagacataccataaaagatttttaagatttagtatggaggcaggaatggctgtgtagcctggagagctacataggctgatagcaggctttggatgctctgagccgtatgtccatgcagctgtggtgaaagattctgtgcacgttgccaatatcctatctcgagcatgtgtcgcagcacacactgcagtgtttctcttcctttgtgcctcaggtctttctcctctggcagggaatgcagctcaggtactgatgagaagtgtgggtaaggtaatgcccatggggccacccccaaactaagggagatggtagttgatggataagacttcagcctctctgtcctttagatggataatttggggtacaatttacacaatcctttgtggatctccagtgggaatgagccccatttgctatagtggtaaccagtttaaaaatgtagtcttgattagccttgtttcctcccctctcccacttcccacccaactccttcaattctgctttctaggcttacctcccaaatgaaccacctgcacccggatgcttgcctcaagctcttcagtttgagagtagtcatctaaatagagatgataatttgaatcacagttgtctaggcatatgcagctgtgaaaaagacagctaggttcatccagggacaatttctgtcacagatgatgtgacagaattgaagggtaagcatgtttgaggtttgtgcaagagaatgaatgaagttttacaccaagtattcttagctagaagtgggaaaatagaggatttatttcactggagggtttggtaaaaattaaaaaaaacaattgtagtagctcttaggcaagcaagtcagatggatagaaggtggtggtcacgatagggtgtttgaattagtgatttcagaggtgtttattgactcttggattcctaggaaagcactcttaataactcaatcctgcaatttcacttctgctgtatttgggggcaggctgaataggctaggattcataggtctaattttatactacagttctctgaactttgataacctgatgcaatcatcttctatttgatcaggtcgctgcccagagatctactttggccagacacgttgactagattctgaaaaaaccttacttaattttttgctgttttctggaccaactgtattttatgaactaatctaatgataatagctttaattcatatattcttagaggaatattgtgaggagggagttgaagggatagctttttatgtttgtatgtggtgctttacatgatataagcttataaacttttggcacaacatcatctgttttttgcatgtgtgtactcacacacatacacagaaaacacaaaatttcagaaagtatgaagggaaatacactggaatatcaattagttgtcctgagatagcgagaatatggggtactttttttctttccatttatctgtgtttttcatgctttcacaatgagtgtaagtttttgttgcaatggagagagtgattcatcatgggctactctgggtggctgtgggtctttgttttgctcgtttgtgcatgcccagttctggcacatatgaccactcaatgtaaggtcagtgaatatgagttaggcagggaagttaaattaatctcagtttcatagacgaaaaaagtgagggtatcatttgagatgttttcattgcaagtgttagaatatgcaactaaaagcaatttaaaattgtaaaaatgtattacttcatataataagttcagaggcagagtgatcctatggttgactaacttactagcacaacagtgtcgaggatccaggcactttccatctttttatctgtcttccttggcttcttattggtgtctcccctgatgattgcaagaggaccatgtatccattatgtatttctgcataataaaccaccataaaacttagtgacttaaagtaatagcagtcgtttctcttccttatgattttgtaatttgtgtaggtatctgcagggcttaccttgctccatgtggcatcagctgaggcagcttgactaggggctggcaatttggtactgtttaatactggttgcttagctgggactgagggctggaggccttggttgttttccatgtggacctctcttggcttttttacaacatggaagctagatcttaagagtgaggattccaagagacatgaaggagaagttttcagtgtcttaatatgttgtcctggaaaccagaatcatttttgcttgatcctattaggagtcacatgatctcagattcaagaagagaagatatagaccctacttgttgataggtggtatttcataggacttcaggagccatgttttaacacatctacaggtagttttaggtctagacattacatgcagacatgatgaagagggaggtttcttcctgtgtacttctttttactgaggaagaatgcctctttttttttttttaacataattctattcagtttccgttagccaagattgggtcacatgtccatgccaaaccaatctctaggtacaggaatagaaaacgaagttacagatttctctgaggtgtagatatccttgaccctacagaacagctgggcaaggcctggaatggatagaccagcttcatcctcttaacccaatgaatactaattacaaatagtataatttttgtatttgtctgtgacagagaataagttaggagactggtctatactaatctttatttactccagtggtcaaacctgggatcatcttccttgaacacatggaagggtgagcagtacctaatcagaattagagttctgcctttaaggaagaagagaggaaggataccaattaagttggagacccacagtatctgcaacactgaggtttaggaagtttaagggcccaaagccaagactaagacccagtttttggacacttgacccaatgttagttgttttaaccaacactgcttctcatggagttggagaatgttagaggtagaagggacctaagagatcatcatgtttgattttgcacactctgtagaaaccacttattcagtgtccctgaaaggtattccaccagcctctgcttgattatattcagcagtggagctgtcagtattcaaaagacacttctattggtgaagtactccttgttagaaattatttcttatataataagaaattaagtgggacttttccttttcctgcagaaatgacatctggcccatgtgctgaatatattacattcagaaaaaaaaagccactaaggactggccagtcttcttctttcagaattttctgagagtgacaaactaacactaccacagtcaacctcacatacccctaccttccaattctaaaaggacttacctggggagaaagggcagaagagaataggatcttctgtaacttatttatggtgagaggttacttcctcccttccagaagccacttaaaatagaatttcaagatgaagggtgctagcaacaagggtagccaagccactccctggcttacgaagctgggaacccataggcctatctaacagttgctcaccttccttagagatagcttgttgtgtgtaccctggagtttaggagtatttataagcatagcgactgaggcctgcttttcatttgtagattcctgaaggagggagacttgagggaatagcctggagtgaataaagactgtggtgccatatgcctggaaagggggtgagaggtctctgctgtatcagctagctattgctgaaaaacaaaccaccaaagacttaatggtttaaataacacatttattgttgctcaatcgtctacagccctgttggtgtgttaggattctctagaaaagcattatataggtgtatagtgtgtgtatatatatatatatctccaaatatatacatatatgtgtatatatatttccaaatatatacatgtatacgtgtgtgtgtgtatatatatatatttccaaatatatacaaatatgtgtgtgtgtgtgtgtatatatagtcctctttgctttatcaaatctttacatgacatatttgctttagatatatatttttttcctttctaagcaataaaatttatagtatagttggggcaccctgtgagtcttccttgtcatgatttcagagtttatcattcttgtgcatgatttataactttgctgcataggcacagtatccataaataggatatattgattttgtaggtctttaaactttatcacactgcaaataacattctgaaacttgcattttttttcagtcaacattatagttttgagaactatacacattgatgaatgtaaacttagtttattcatttttgtggcagaaaagtgttctattgcagggtggccaacctttttctgtaaaggtatggaagaaaaatattttagattttgcaggccatctatggtctgtgtcacatattgcaaatccaagaaagaaataacttgtatatatctgatagtagattggatgccctggtacttttttcactttattggcttacatttctaacaacaattccatttaatggttttctgcaccagaggtcattttcagctatagtcagtatagtatacatagctgctatagcaacctaaacaatggtccatatgattgtgtaatggtgtatgcttattataagattatattaagtctacaagacttgaaggtgggttcatattcattcctcctaaattaaacccacctccaaatgggccaggggggagaatgcttccatccacccaccaagagttttcacttaggtttggctttggcatgatgtcggctctgattttttcctggagtttgtgaccacaagtcaatggaagttacttagtggtacacagcgggaagacatatgcctcctacccacctccacacaagggtgtcttgtcaaggctgtgcctgagtttagggaaacgtgtaactgctgcttatatagctatttgaataatccaatatccagtatagaccttctgattcctcacccacatctctgtaaagtaagtaggtcttggtagtgctgcatagaattagaggcactgagcaggtataatcacacacagaagaagtgatatcctcacaaggtccaaaccatttattgtttattctttatatcctacctgtttctaaaaggctttcatgttgtttacaaccatggacacataccaaacatgaccataaaataagaagaacaaaaaataaagtatttgaaaagagggaagggaagatagattgggaggaaaagtacactgaggattattgtggtagttgaaaagattagtggaggtaagaatgtgcatgcaaatatttgtgagtgtctgtggttcaagggttggcaaagggaaaaatacaagaaattgcttcagtcatggaggatctaatggccatgctgaattatttacaaggttcactgtacatgagtagctacattttaagaggatttgtgatgccttgccctacctgaaaatctgcagtagaatagagaaactctatcttgggattctgagtggtcttgctaccattttgctgttagataccattttgctgctaccattttgctgatagagggccccatacatgagtctaggatcttacttccttgatctggctatctaaaggaagagtttttttgtttgtttgtttgtttttttggtgtaactcaactcactgatgtcccttttctctgcctgaggcaggatgataaggaaggaggacaagttgctagggcagatagagggatctgcttctgccccacttctctctgatcattggttattccttgagaggcaattctcagaaaccagcttagcatagtgaggcttacccattcccgggtgcctgaccagcatgatttcagaaggtctttacatatgaaatattcacataatagaagacagacgtgaaatttgggctcagtggaagcaaggaagaattggacaaatcctcaaagtacgcttggtggattctccagactccttagggtcctgggcagttttaagggtagcagactccttcctgccatcaagtgataaaagagataaaatgtggagctgagaccactgctagggaaatagactaattatatttatttaggcagaagagcctactggttaaggctacgattctggagcaagactacttaggttggaattcctgctctgttagctgagtgatctctggaaagttacttaacatctctatgtctccactttctcatctctattatgaggataataacagtatctactttataggattgttgttagaattaagtgattcatacctgtaaaattcttacaatagtcccttgtcatgaattaagagtgcaataattttttgcataagaaagatgagctggaggagatcttgtcatccaggtacttaggcaagaaatcgaaatacagctgggagaaaagaacaaaatcactcaggacctctgaggattatagagtatacagttataatcacatcatgtgggttgtgagtgatgggccatagtatttgttctcacaattctgagaacaaaacaagatataaatatgtattgaaggaagagtcctcaatttttgactaaacatctggtaaactggcagatgttcaagagagattttggtaacagtgagatcttagtcagtaagactttaagaattttcttttaacagtactagggtatcatactggttatatctgcagaatgagttttgctatagtaatctaaataggggtttatgtaatgtctattttctacttggcattttgccagggtagggaaaaatatctctgaaacaacttcattgtaacaatgaaatgatagtcctttttgcctttaaaaattgtaatctaataaacatttatcgagtgcctactaagtatagtaatagtgtacctagttttttcaaatacatattattattgaagtataaagtacacacagaaaactatactcatcataagggcaaatcttgatttatcacaaagtaaacttactcatgtagttctgtatccaaggtgagaaacaaaagagtatcagaatccccaaaagactccttatgtttcttttcagtcactttcctcacccacctcccccaaaggtaaccactaagcagaaagccgacttctcacactacagattattttttcctgggttttaaaattttatgtaaatggaatcagggttctggtttctttcactcacactgtattcatgaaagttatccatattgcagtttgtaacagaagtttgttccttagcattgctgtataggattccattgtatgaatataccgcaatgtattgatacagtctgcttttgattaatatttaggttatttccagattgtgactatgacaaataatgcttctgtaaatatccttgtgcgggccttttagtacacatatatatgcagttctgttgcatgtatatgcaggagtagaactgctgggctgaaagcaatgtcaatgtttagcttcagtagagactgcaaaggcagttttaccattttacactcccataagcagtgtatgagagttccagttgctccatatccttgccagcacttggttttactttttgtgatggagtagatgtatagtatctcattgtagtttgaatttgcatttatgactaatgaactaattttcttttcatgtctttagtggccattttaggggtatgtttgtgtgtgtgtatgtgcatgcatacacatgtgtgaaatgactgttcaggtattttcgctcattacaaaactgagttgtatttacccttttggtccttgttcataccttcttgtatctccatgcttccacataggatcatttcttgtgggcctgaaatactacttttaacatctctcctttagtgcagatctgctggtgacaaattccctctcctcatttttgttttgacagaaaatgtatttcttttcccttcatctttgggactgtgttacttcctacttttagattatcattcatcttccagcttccattatttctgttgagatgctactgtcctctgtcattattgttactcgtttgaagttcatctgtctacttatactttctgactgcttttaaagactttctctttgactttggtgttcagcaattttaacatgatatgcttagttgtggttttcttcatatttacctacttgagttttgtagcatttcctcaatctgtggtttgatattttagcagtttgagaaaattctcagccttcattgcttcacatattatgtcagagccattcttttctctctctttctctctttctctctctctttttctctatctgggacatttccactctactgtaagtttttcatgctttttctttctccatttgagtgttttcttctgacctaccttctagtgagtactaattatctttatagctgtatctaatctgctattaaacctgtttatttcttaattgtaattatggtatttttttagttctagaattgtcatttgagtttttaaaatagtttccagtctctgataagttcccaattttgtcacacaattttaaaatcatataaattatagttattttaagtccatgtcagattattacaaaatctgtatctcctacaggtctatttttattatctattattatttttggattttggccattttttgttgttggcataccatgttatttttaatttaatgccaggtatttgtaagaaaaaaactagagaaaatttgaggctctgcatgaactatctttctccaggaagattttgcttttgtttatggcagtcagatggactagatgcagatcaacttgactcagtcatgacttgagatggttgaaatctatatcaatctttgcgagggcttaatctctttccagtcatccttactcctgatgtcctttgagtttctactagaaagctttgggtgtacaccaggatcattatggggcctgaatgtcaatatttgctcccatacccaccagctttgagagatttctataagttgtattcatattatttgtttcttagtactcattttcatttgggaaaatgtcttgagggaaaaggcagcttcagaattttctcgagagattttttttttctttcaaaagtcttagccccaggagtactcactgctttggaagatctctgatgcctttgaacagatgtttgcctagttgttcttgacagaaataatggattaaacaagctaatctgccatgctagtatggaaatcttttgctttttgatgccttttttagggaattcaaaaagcatgagaaaataaaattggacttttttgtcattttaaatgtttgttgatggccacaaggctaattactgttttatcctttttttcttttccttttttctatcttatgaatttcagaggtacaagtagttttgttacatgaatttattgcatagtggtgaagtctgggcttctacttcttccgtcacccaaataatgtacattgtacattaagtacattaagtacaatgtacattaagtaatttcttatcctttaccaccctcccaagtctccagtgtctatcatttcacactgtatgtccatgtgtacacattatttagctcccactaagtgagaatatatggtatttgactcttctgaattggttcacctaggataatggcctctggttccgtccatgttactgcaaaagacatttcattctctttttatgactgagtagtattccattatatatcgcattttctttatacagtcatccattgacagacacatagtttgattccatatctttactattgtaaatagtgctacgataaacatatgagtgcaggtatcattttaatatggtttatttttctttgggtagatgcccagtagtaggatttcttgattaaatggtagttctgtatttagttctttgagaaatcttcacactgttttacatagatcttctattcattttacactcccaccaacagtgtataagtgttcccttttctcccatccttgccaacatctgttatttttattacttttttataatagccattctgactggtataaaatgatatctcattatggcattaatttgcattttctgatgattagtgatgttgagcatttttaacattttattctataatatatatttggtctatgcagatctggcctttgaattctgacacactttttgggatacctataggacaatgtgaaatctattataagtttgattcatagttaagaatgaaaagcaaccacaaaatatatacaaatggccaatacccacatgaaaataggctggaaattattagtcatcagggaaatgcaaatcaaaatcacaagatacaatttcacacccattagaatggctagaataaaaaagttagataataagaaatgttgatgaagatgtggaaaaattggaatcctcatagactaatggttgaaatatgaaatggtgcaacctactttggaaaacactatggcagttccttcgacaactaaacattacgttaccatattacctagcaactccacttctataaactcaagagaaaagaaaatatatgttcacacaaaaatttgcacatgaatgttcataacagcactattcacaatagccaaaaggtagaaactatccaaatgtttatcaactgatgaatggaccatgtcttgtatatccatacaatggaatattatttggccataaaaaggaatgaagtactgatacatgctacaacatggatgaaccttagaaaccttatggtgagtgaaagaaaccagtcacccaataccacatattctattatgttattcatatgaaagtccagaatagggaaaattttaaagataaaaaatgtatcagtggtttcttaggaccagtgggggcaaaattgatagctaaagtatatggggtttctttttgaggtgatgaaaactttttaaaattgactggtgatggttgcacttatatgcgaatatttaaaaatcattaaattgttcactttaaatgtttgtgaattatagcttcattattatagaaatttttcaacatacaaaaagattgagaggatgttataatgaacccccatgcatctatcacgtcttcaacaattatgtgtttttaccaatgaaggattttttttaagatgcagctgacataggcagattcatacactaggggaaaagagtcaggattaagagagtagttgaaaatttagaagggaaagatgataattgatacagcaaagtttttgaggaggcaagtgatagagtgtagtgcaggtggggagatcccggctccagatcgtaagaaagactctttgttcactgagttgaaagaaaacagataaaaattactgtctctcagaaatctgttgaaaattctaattttcagaagcttgctttgctaacttcctccagtttccctctgccactgcactccatatcccctttggcttcgccagttacctctttgaagtcattcactaatttttttgaaaagtctattccataaaagcatttcatgagttcagtcattttactgaagattcaatgtctacagagagtaatcataatacagaaaacaaccatctaccatcctccatcttacagccagactctgttatttctctaaagcaacagacacactgttcccttgtactataaatagaattgctttcctaagaggaattctggggaagaaaatattctccataactttacatagagattaagtttttggtggcaagtcaggaaatgaacaaatccatgcctagtgacaattaatttctctgtgaattaggaaggttcatctggaaagagttcatttggctggaattgggtaggaggaagctttagaagtatgccaagggtttgaaatattgccaaagccttccttttagctttacttaaagtaatgtcttcccttctaataataatgaaaacagcaaaatgcctccatccatacacacccctaggaaatgagattaggattactaggggatgttagacttctgtgaaatgccacttaaataggcagtactgccaatttatccccttttgtgttggctctgtgaagataaggttgggaaatattgtcagggaacttttctccatttaagtctgaatcagtaggtatttgcatgagcatcattctcatcgttcattagatgacagcttaattatagagctggaaatgtacattggaatcattttgtacaagcttcttgtctcccaaatgtgtctccctccctgaccccatttctatctgtgacattttgtagtgagcacccaacagtagcaatgataattaaagccaatgatttcaaaatattttttatgcattctcagaaggtttctgtggttgattactactagacaccaactgggtaataattgcctaattctcttgatagagaaaaagatgtaatttggaaataattgactgaacaagagaaaaatggatagatactagaaaaaattatgtgggccatagtattgcttaaagcaataaatattttggagttaaaataccataaatataacaatataaatactgtacatgtgtgactacttaccttagattgtaataatttatgcttagctcatcttctgcacttaaaatatttttcttatactggagaaaacataaggactatgaaaaaatgatttaataatggatccttagagtttggaaatttgtaaccacacatacatgtataagtaatatacaaagtatatcactaatatgttctgctttacaatgctccattgaattagcctctcaggaaaaataacttagtgcaattacttcccagtcaactcaggtaatggtgtttctaccttttaaatttgattagtagattccagtctttccagtgaatgacatcattaattaaactcagtgccaaaagactatgagaaaaactgatgctttgagtaagagtgagcttctctcccaggcaaataaataccaaagcttcagagtttttatgtctaattatagatgtttttccatttattcgtaaataggaaaaacctttattcctatacattttaaattgtacatttagatagagacaattatgttacatggacagaattacatagaattgaattttaagaatcaagcatggataaagctacaacaatcaagacagtgtagtagtggcaaaagaacagacaaatagatcaatggaacagaatagagagcctataaatagacccacataaaaacagtcaactgatctttgacaaaagaacaaaaacaatacaatggagaaatgataatttttaaaattctagacacagaccttacacccttcacaaaaaattaacctgaaatggctcacagacctaaatacagaatacaaaactataaaattcctagaagataacataggagaaaatctaggtgactttggatttgatgattgctttgtagatacaacaccaaaggcatgatccataaaagaaagaactaataatctgaacttcattaaaattaaaaattcctgctctgcagaagacgctctcaagagaataaaaagacaaaccacagactgaaaaaatatatttgcaaaagacttatctgataaagggcttttatgcaaaatgtacaaagaacccttaaaactcaacaataagaaaacaaacaatcaagtaaaaaaaaaaatgggccaaagaccttaacagataccttgccaaagatggacaagatggcaaataagcatatgaaaatatactccacattatatgttatcagggaaatacaaattaaaacaataatgaggtaccactatatacctattggaatggaatatcatttaggcttgaaaaataaggaaattttgccatttctcaacaacgtgaatgaacctggaagatattatgctaagtgagataagctagacacagaaagaaatatactgcatgatctcatttatatgtgtaatctaaaaaagtcaaattgatagaaccagagaatcgaatggtagttactaggggcaggaatggctctgggaaatagggtgatgatggtcaaaggatacaaagtttcagttatgtcagataaataagttctagagatctaatatacagcatggtgactgtagttaataatacctgaaatttgctaagtgttctcacacagaaaaggtaactatgtgaggtgatagatatattagcttgactatagtcatcattttacagtatatatgtataacaaaatattatgttgtacactttaaatatattggcaaaaatccagaacactgactacagaaaatactggtggggatgtggagcgataggaactctcattcatagctgttgagaatgcaaaatggtacagtcattttggaatacagttgggaggtttcttataaaattacacatgctcttaccctgcgatccagcaaacaaatcacacccattggtatttaccctaaggagttgaaaacttatgcccctccaaaaatctacatatggatgtttataacaaatttattcataactgtcaaaacctagaagcaaccaagatgtcctttaacaagtgaatggataaataaattgtggtacatccagataatggactattattcagcactaaaaagaaattggctgtcaagtcatgaggagatatggtgaagaaaacttaaatgtatgttactaagtgaaaaaagtcaatctaagaaggccacatattgtatgattccaactatataacattctggaaaacgtaaaactatggagacaataaaaagatcagtggtttccaggagctggagactagggagggatgaataggtggagaacagaggatttttacacagtgaaactactctgtatgatactgtaatggtggctacatgtcattatacatttgtccaatgtgtaatgtccaatgcacccataggatgtacaatgccaagagtgagccctaatgtaaatgtaaactttggatgataatgatctgtcagtataggttcatcagttgtaaaaaaatgtaccactctggtgggggatgttgataatgggggttgttgataatgcttgtgtggggtcagggaatatatgggaaatctctgtaccttctgctcaactttactgtgaacctaaaactactctaaaaaataaagtttattaaaatgaataaataaacatttcaagatatttttaaaaaatgaagcagcaggcatggaagggtattatctcaattttatgggtgagaaaacagaacccagagaggttgccattttttcagtgtaaactggtgagacaagaaaaaaacgagagccaggctgtcggttcctaactcatagccctgcttcccatccttccttgtgccagtatttagagatgttggcagcctgtagtaagtgattatatttcagttttgaccacagtctacttatgggttggcatcatatatcttagatagtacaactcaaggccaacagtgctgtgctctggaatgtaataccacgttccatttaaatgagctacatcttgtctccccaaacttctgcttctattataaactggataaacccattacccataagtcattttaagaaataaacagagttgaaacttcttgaaacactaaggactttcagcccaagacagatagactctcagtaacagtgaagttctcgtttcttcagctccccacagaatttaagaatgcaaccacagtgagtattctatagtcagtgtatcagtttaaaagatcctgcagatatagaggaacatactgagcaacttattactgtttgtatatctactgctggtatgtgctgagggacatcaaaaggaaatatcagatttggttggtcggtcttgattccccagaagcttagaagccaattgaggaaacaaaacacaccatgtaaaggactctacatattcagacaggcccagatgaggtcaggaatgtattttagtgtgagttaccctgaagcaggccctacgagaagaatttgagtgcatatatctggggaggaagatgtaaggagtgtggaagaagagaaatgaggcagggaagggaaggcagccaataaagggagacaactattagacaactatcaccatgcgtgactagaagttaatccaaagagcaaatactaggaaatgtcatagaacacatgcctcagagatattctctctgatggatggggaagccatagtacttgtattccagctcctaatctgggctggaattggggcattgagggcgctctcgggagtattaattcttggcacttcagcctgacaggcacctggatgcagcagctttctgcagttctggaaaacatactcaagcacagtgggcagatgctaacaactggaagtcaggctgtgcacataaaacagaagagtccaaggaatgcgggtggggtgctgacagagtgtctgctgcagtaggattcctagtggaggtgagacttgatgatactctctcttttctccccaggtctcctcatgaccatatccctgttgtccattgtgtatggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaatttagaagataggtgagcaacttgagtgatcccaaaccaaactaacagtgctggtttgtccgacacccaaagcccacttcacacatttataaggacagagatttggtaactcatttgggtattttgtcagttttaacccttaatatacaggtatcccagctttgggcacatgtatgtccattcactttcaggaaggggtgtcagtactttctttctgtgtggtgaaaacataagccatggtgaactgataatttttgtttttaaattatttatattactgaattggcaaaattacagttcacactgcagagctaggttgtcctattggcataaaacaaaccagcaacttttctcatgtgtttggagttaaaatgtgtttttcagttataatttcaatttttaaatttcttggtgctttgtctaattaattacatcccataacttgtcaggatagttgctccaactgaattgctatcatttggctggatgggggtgaagtatgtcttcaaaatatattgaagtaagttcatcaaacatgtttagacttcctctcattgctggagacagcccagtgtagagattggcacttccctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgtatttcattctttatacaattcttacatggcctttttacttcagggactatttttaaaacagaaattttaaaattgtttcattgtaactgattatagttttataaactcacctggaaattacttctgtaggctgagaaatttgagagtgctaagattcagccttgcagaacaacaacagtccatgaaaacctctctgattgttttatagacatttactccacttgttaaaattacactgctggatactaagattctgttcagttgtccatcagttgccatgcacaatacaaaaaagagaggcaatacacatctcttctagacaaacataaatatatactgattcagaaatataaaacaccaaagaaatggcttggtattaacatacataatcaaatgtaaatggttgggaaaaacatcagtcattaaagggatcatttcagagcatgagagagacatggactgtttcaataattcctttgcttctgaaggtggccttggaatttgcaaagacttagctataggataaatctctttaaaaacagctttattgaggcacaattgacatacaaaaaactgcacatatttaatgtatacaatttgatgaatgtgtacatatgcaaacactcatgaaaccatcaccacaatcaaggtaatagacatattcatcacttctaaaaatttccttgtccctctttgtttttgttttgttttgtctttgtaagacacttaacatgagatctatgctcttaatattttaaattcacaatacactatcgacaactataagtactatgttgtacaacagatctctataacttactcatctaacgtaactgaaactttatatccattgaacaacaacttcccatttcccctaccccccaggccctggcaattgccattctatcctctgcttctatgagttttgctattttagacaccccatctaggtggaatcatgtagtatttgtccttctgtgtctagcttatttcacttagcataatatcctccagattcttccatgttgtcacaaatggcaaggtatcctttttttaaggctgagtagtatttaggaatatgccatatattctttatccatttatctatcaatggacatttaggttattttcatatcttggctattgtgaataatggttcaatgaacactggagtgcagatatctcttcaagatcctgatttcagttattttggatacatacccagaagtggggctgttggatcatacggaagttttatttttttaattttttgaggagccttcatactgttgcccatattggctgtactattttacattcctatcaacagtatacaagtgttctaatttctccaaatccttacttacatttaattttttgtttttttggatagtagccatcctaacaggtgtgaggtgatatttcactgtggttttaatttctagtttcctgatgattggggatgttgagcaccttttcatataccagttttccatttgtatgttctctttggaaaaaggtctattccagtcctttgcccatcttttaattgggttattaaacgctttcttttattgagttgtaggagtttcttacatgttttggagattttcagatatatggtttgcaaatattttctccaatctgtagatgtttttcctttgctgtgcagaagtcttttaaaataaatattttcatgttaaaaaaaactgagtattaacaattatagcattcaagtaggtcaatataaaattatttaatttggtgtttgttaatgttttattttgaaataattttaaactaatagaaaagcctgaagaatagtgcaaggaatttctttataccctttacccagactcacctattattaatatttttccatgcccgttatcattgtcactttctctctctttcttgtaaaccctttgagattacactgccaacgttacacccctttattcctaaatactatgatgtgtttttcctgtgaataaaggtattctcttacagagccacactatagttatcaaattcaggaaatttaatattgacacaatactaatatctaatctaatatccatactccagttaacaattgtgccagtcactttatttgctttcacaaagcttgtgaaaaccatgtgaatcaactcagttctcttctgtggggttgtctttatttaaaactatgagtaagttttaacttttctatgaataatgggagatctacagcagacgttgaagttatttgaagaaaatatgtagatgctatcagtactaactaatagcttaaaaactggaaatttgagatgtttattggcaagctgggtaattctttttcatgaacatcctttttaggcttcaagtgtttgctgtttaatatttgaatctgtagttcactcccatcctctgccctgctgttataactctattttacagtgtttgggcccaaattttaaaagattaggaatgaggtgagttaagtagatattattctgctatgaccatatttctctgggtgtccctcttccaggagactatattttctatgaacatctctccaactgggaaagagctcagaaatctcaactatacattttaattaaatgaataacattttgagcatttcctctttttcagggaaaggcactttatagcagcagagatttgtacagagctggaaattcagaagcatcccaatctctcctttcccaacacacacacacacacacacacacacacacacacacacacacacaaacacacacacacacacacacacaccctgtcagagtagaccccaaatatgctaagaagttgagtctgccacagaagcctgctctagggaatgacctaacatcttatcaccctctctgcatggttgtttctctggaaattattaggccaaggagatctagaatacttggtttaagcaggttttagaatccagagcatctttaaagagtgttacagcagcatgcagccgtgtctctctgctgcaggttatcagaaaacttaacactcagactctgctgtagcatgcacctttgtgtgagggagtggagggtttgcctcctcccaagaaggatagatttagctaaatcaattttgaggttctgcctgtgctttcactccctccctgcctcctatcctgaattaattttctatctctgaatgatgagttcctgattgaaacctgattagcctgcttcctaaagccgtggaaataccatctcccttagacatatacattatgcatactggtttaatttcttatcagtttgcttcctatcttaattacctaaactctacagttaatgagttaggttttcaggggtgatagcactcaagaaataaaacaggattttgaaattctattttggagtggtgctgcaacaccacacccaccgccaccctagcagggaggagaatgattcccttttgtcatcttcccctaacaaggtgaccttcttaattggattggcagaattttctagaaaaatggtgcctggctgtagggctgcaggcctccaagaatcagaggtattgtgatcctctccactactacagatatctggcacacacttgtgcaattctttttcaaaccaatgggaatgctgttgtgagtgataggacaggactgattagaagtgtcactgtagtcaaagtaattttgtcatttttctcccagctcccaccatgaacaaatattaaaaattcaaccactgttatgtggagggtgaccttaaagtatgtcttttgtaattgaggttattgggatctattaccctgggaagtttttttttttctgctgaaatattttctcctatggacttatggtatagtcttttccttttaaaatgaggatagatcacccacacatcatgcggcttctctcatttacagcttgattcaagagatcaggaaatatgtttattttaaaagtgtactgtaaatgtcctaccttaaaaaagtacattatctaccttcacaggaagtatgtaatcaaggtgaaatgcttctatcgtttcaaattattactaaatgtatattactatcataatatccatcaaaataatatgatttctacagtcttcaattcacctcccagtttacttccttagccttattataaataatatcagggtgctttcagctacaatttgtagaacacctggttaaaagtggcttaaacaataggattttgttatctatattaacaagcagtttggaaagaggtgattctagattctggcaggcaaactatccttgggccccagaggctttccatctttcctgtcaccttcaacctgttcctccatcttcacgcttgtcttcacattattgaagcatagtaacctgacctccaggtatcacgtatacaaaactgaatctgagcttctccttcttgaaagatggagaaggtcccaagagttccggaaggaggcaaagtggtctttttcagccgccagggtcacacatttcctccagtaccgtgagttacagagaaaaagtcctaatccttctgcctgaatgttgaccttattttctaggtcttagaattctttggtattgctttacatttcatttcccacccctcaaactgaatttattgtgtactttctctggagaactggttccgaaggaaaaagaaaagcaagctttctattaagccctaaagagctaacagggtacagcaggacaatttatatccagacagagcgttggggtaataggagaaaacaaatattatgttcttggagccctggtatcatttgcatatttccaaaggaaaataaatttgatgctagaatgccatctctttaaaagcactcagttcaacatctaatactaattccacaatattaacaccagcaatgtccagtatggcagcaactagccacatgtgactactgagcaagtgggatgtggttattccaaattgaaatgagctctaagtgtaaaacccacatgagattttgaagatttagtataaaaattcaaaatatcttaataatttctacatttgataccatgttgaaaagataatattttggatatatgaggctaaatgaaagatactattaaaattaatttcacttctttctacttttttttactgtggttactaagaaatttaaaatttcccctgtagctcccatatctggtttgtgttacagtggacaagacattttacagatatgtacactaagtgtacaccagaaaaatgccagattagccaagatctgttccttggatggcatttcccttttttcatgtcaggaaaagtgtgtttacaataaaaacaaggatgtctcactctaatgtattatttatgtgctcagagagtgtcctgagcaatgaggagatgttttctttttcttttctttcttcttcttcttcttcttttttttttttttttgagacagagtcttgctctgttgcccaggctgcagtgcagtggctcgatctcagctcactgcaacctccacttcccgggttcaagtgattctcctgcctcaaccccctaagaagctgggactacaggcgcctgccaccacaccctgttaatttgttttgtatttttagtagacacaggggtttcaccatgttggccaggctggtctcgatctccttacctcaaatgatccgcccacctcagcctcccaaagtgcagggattacaggcgtgagccaccatgcctggcctagatgttttctattaagtggtttccaaacatggcttcccattggaatcacctggagatgatggggtcgttgaaaatgctgctgccaggccacacctcaggccaattaaatcagtatctctgggcatgggacccaagcatcagggtttgcatctgggctctccagtattccagaaatctttctttataagcaaaagtaggtgtctggggcttacaacagtcaatcagtcatcagatataagtatctaaaagtaacagaatcactgatttcctcacactgtgttcagatgttcaagtaaatgtagcttctttatatcctagatggatttgaacttccttgtgatttcctgcccgaattgggtaccaaaaaaggtggggggtgaggaaccagccttgctaagcccagtgtccccatctctgctcaccaggtgcgtctgtctctttggagtgactgcacgtctatgaattaagcactctatttttcaggatgcctcccctgcccttctccttccctgagatggcagcacccaggtgtatgggagagacactgcgtgccacctcctggcagaggggtaccaggacctactggcctgaggctgggcccagggctgggtcaggcccgagtttgctcacatgggttcctctgagttctgctggactctgctgctgagctcttcagctgtcagggcctgtcctctgcttgcttccaggccttggcttgggttggtctactgtgagctgcggcccaggagccacaccatggcctcttccaagggcctggactgggcagttctacacaggggcaccatggaaggctctcatccctcagcttcacatcccaccctcccatggatgaggctgtgctcctgggttccacattgcctcaccaaagggccactttctgccctctgtcagcatgaccacagctctcctgcttgggaatgtgggatcagacagcaccccagacaagggaccctcagacagtgcccaatgggaagagacagagaaacccctgagcctctggtattgcctcaaccaatttattgtgtccttcccaggcttagttgtggaggaggctgtcaggatacaggggcctcagtaacagcctccctcttcccacagtctatggatgcctaatgcctcttgctctacttcatagcctccttgctctaggccagcaagcctccagtgccaggcatcccaggttgaagcagtgtcctctctgcactgtgggggcactgtggcctcagccctctaagacttgcttttgatctgctaagtgagagatacacaaaaaataaaaaagcaagaaattaattcatattacaggagaaaaccatcttcactaaaaggaagacaggaaggaaagaaagaaggaagagaagaccacaaaataactagaaaataaataacaaaatagcaggagtgactccttacctatcaataataacattgagtgtaaatggactaaactctccaattaaaagacatagaatggctgaattgattaaaaaaaaaagatccagtgatcttttgcctataagaaacacacttcacctataaagaaacacatacattgaaaataaagggatggaaaaagacattccatttcaatagaaaccaaaaaaaagagtaggagtagctatacttacatcagacaaaatagatttcaagaccaaaagtataagaagagacaaagaaggttactatgtaatgataaagtggtcaattcagcaagaggatataacaattataaatatatatgcacccaacactggagcacgcagatatataaagtaaatattattagagctaaagagagagaaaccccaatacaataatacctggaaacttcaacaccccactttcagcattgtagagacctccaagacaaaaaaagtcaacaaagaaacatcaggcttaatctgtactatagattaaatcgacttaatagatatttacagaacatttcatccaatggctgcagaatacacattcttttcctcagcacatggatctttctcaaggttagaccatatgttaggtcacaaacaagtctttaaacattttaaaaaattaaaataatattaagcatcttctctgaccacaatgaaataaaagtaaaaatcaataacgagaggaattttggaaactacacaaacacctgtaaattaaacaatatggtcctgaatgagtagtgggcaactgaataaattaagaaggaaattgaaaagtttcttgaaacaaataataatggaaacacaacataccaaaacctatgggacacagtaaaagtggtactatgaggaaagataataatagcattaaccgcctacattaaaaaataagggttagtttaaataaacaacctaatgatgcatctaaataactagaaaagcaagagcaaaccaaacccaaaattagtagaagaaaaaaattataaagatcagagcagaaataaatgaatttgaaatgaggaaaacaatacaaaataccaatgaaacaaaaagtttgttttttgaaaagataaaattgacaaaactttagccagattaactaagagaagacccaaataaataagagctgagatgaaaaaggagacattacaactgatactgccaaaatctaaaggattattagtggctagtatgagcaactatatgccaatgaattggaaaatctagaagaactagataaattccataaattcctagatacatacaacctaccaaaattgaaccatgaagaaatgcaaaacctgaacagactgatagcaagtaacaagattgaagccataataaaaagtctcccagcatagaaaagcacagaacccaatggcttcactgctgaattctaccaaacattttaacaactaataccaattctacacaaactatttttaaaaatagaggaggagggaatacttctgaactcattttacgaggccagtattaccctgataccaaaaccagacaaagacacatcaaaaaaagaaaaaaagaaaactccaggccagtatcactgatgaatatcgatgcaaaaatcctcaataaaatagtagcaagctgatttcaacagcacattaaagagattattcatcatgaccaagtgagatttatcccagggatgcaagcatggttctacgtatggaaatagattaatgtgatacagtatatcaacggaatggaaggcaaaaactgcatgatcattaaaattgatgctgaaaaatcatttgacaaaactgaacatctcttcatgataaaaaccctgaaaaatctgagtatagaaggaatatacctcaacataacaaaagccatatatgacagacctgtagttggtatcatattaaatggagaaaaactacaggcatttcctcgaagatctataacacgataaggatgcccactttcaccactgttctgtaaatcctagctagagcaaacagacaagagaaagaaatgaagggcacccaaatggaaagggagaagtcaaattatccttgtatgtagataatatgattttatatttggaaaaacttaaagactccaccaaaaaaactattagaaccaataaacaaattctgtaaagttgcagaacacaaaatcaacatacaaaactcagtagtatttctatatgccaacagtgaacaatctgaaaaagaaataatctcatttacaatagctacaaataaaataaaatacataggaatatagcaaaaaagtgaatgatctctataaagaaaattataaaacattgatgcaagaaattgaagaagatgcaaaaaatggaaagacattccatgtttatggattggaagaatcaatattgttaaaatgtccacactacccaaagaaatctacacatttaatgtaatccctatcacaataccaatgacattcttcaaataaatagaaaaaacagtccaaaatttatatggaacacaaaaagacccagaatagccaaagctatcctaaggaaaaataaaaccggaggaatctcatcacctaactttgaattacactgcagagatatagtaacccaaagggcacagtagtggcgtaaaaacagacacatggatcagtggaacagaatagagaatccagaaacaaatccacacacccacagtgaactcatttttgacaaaggtgccaagaacatacacaggaaaagacagcctcttcaataaatggtgctgggatgattctacatccatgtgcagaagaatgaaactagactcccatctctcactatgtataaaaatcaaatcaaaatggataaaagtcttaaatctaatacctcaaactatgaagctactaaaagaaaacattggggaaactcttcaggacactagagtgggcaaagatttcttgaaaaacacccgacaagcacaggcaaccaaagcaaatatggacaaattggatctcatcaagttaaaaagcttctgcacagcaaaggaaacgatcaacaaagtaaagagacaacccacaaaatggaagaaaatatttacaatctacccatctgacaagagattagtaaccagaatatataaggagctcaaacaactctttaggaaaaaaattttataatctgattttaaaaagggcaaaggatcttaataaacatttggcaaaagataagacatacaaattgcaagcagacatatgaaaaggtgctcaacatcattgatcatcagagaaatgcaaattaaaactacaatgagatattatctcaccccagttaaaatagcatttttttttttttttgagacagagtctcactctgttgcccaggctggagtgcagtgacccgatctaggctcactgcaagctccgcctcccgggttcacgccattctcctgcctcagcctcccaagtagctgggactacaggcgcccgccaccactcccggctaattttttgtatttttagtagagatggggtttcaccgtgttagccaggatggtctttatctcctgacctcgtgatccgcccgcctcggcctcccaaagtgctgggattacaggcatgagccaccatgccctgcctaaaatagcttttaaccaaaagacaggcaataacaaatgctggcaagaatgtggagacaagggaagtctcatatgcagttggtgggaatgtaaattggtacaaccaatatggagaacctagttttctttacagtaggtttaagtgggcttaaaatattcagtaaatcatgctctaagcagatgtgctgtcatctaggctttgttgtttcatttctggagcacaggcagagtagatttggcataattcttatgggccctaggagtttggaatggtaaatgatcattgctttcagcttaaagaaaagaaagaaaatgtggtacatatacgcactggagtactatccaggcataaaaagggatgagatcctctcatttgcaacaacatgtgtggaactggagatcattatgttaagtgaaataagccaaccacagaaagacaaactttgcatgttcttccttatttgtgaaagctaaaaattaaaacaactaaactcatggatatggagagtagaatgatggttaccagaagatgagaagggtattggttggaggcagagagggtgtggtcaggaagaagtggggattgttaagtggtacaaaaacatagttagaaagaatgagtaagacctagtatttgccagcaccacaaagtgactatagtcaaaaataatttagttgtacattttaaaataatgaagagtgtaatttgtttgtaacacaaaggataaatgcttgaggtgatgaataccccatttacctggatgtgattattatgcattgcatgcctgtatcagaatatcttatgtgacccatgaatgtatacacctattatatacttacaaaaattaaaaacaaaaaaatgaaattgcagcaattcagtcacttctttatactccacttctaattctagctctcttgctatttctaccacatctgcagttgcttcctccattgaagttttgtatccttcaaagctatccctgagggttagaattaacttattccaaattcctgttaatgttgatatttctgactttctcccatgaatcatgaatgttcttaatgtcatcttaaatggtaacttttttcagaaggttttcaatttcctttacctaaatccatcagactaatcactgtgtatggcagctacagccttacaaaatgtatttcttacataataacacttgaaagtttaaacaactctttgatccatgggctgcagaaaggatgctatgttagcagacatgaaaacaacattcatcaccatgcacatttccatcagagttcttggttgaccaggtgcaatgtcaatgagcagtaatattttgaaaggattttttttctctacagtaggtttatgtgggcttattcagtaaaccatgttgtacacagatgtgctttcatctagaaatgtgcttcatttcaagagcacaggcagagtacatttggcataattcatattggccctaggagttttggaatggtaaatgagcattgtcttcagtttaaagttaccagcagcattagcccctagcaagacagtcagtgtcttttgaagtttcgaagccaggcattgtcttctcctctttggctatgaaagtcctagatgcatcttcttccaatacaaggctgtttgtctacattgaaaatatgttgtttagtgtagccaccttcttcaatgatcttagctgaatcttctgggtgactttttgcagcttctccacctgcacttgctgcttcaccttgcatttttatgttatggaaacagcttctttctttaaacctcatgaaccaacctctgctagcttccaactttgtttctgcagcttcctcacctctcttatccttcacagaattgaagagctagggccttgctctggattaggctttggcttaagggaatgttgtggctggtttgatcttctatctcgactattaaaactttctccatatcagaaataaagctgttttcctttttgtcatttctatgttgactggagtggcacttttaatttccttcaagaacttttcctttgcattcaaaacttggctgtttggcacaagaggtctggttttttgcctctctcagctttcaacatgccttcttcactaaacttaatcatttctagcttttggttgaaagtgtacatgtgtaactcttcctttcacttgaaaacttagaggccactgtagggttattagttggcctaatttaatattgctgtgtctcagggataggaagggctgaggagtgggagacagatgggggaactgtcagtttgtggaacagtcagaacgcacacacgtttatccattaaatttgctgtcttatatgggtgtggtttgtggaagaattccgatagtaacatcaaagatcactgatcacagatcatcataacaaatacaataatagtgaaaaagtttgaaatttttcatttctttaaaacatttcagagaattaccaaaatgtagcagagacacaaagtgagcacatgctgttggaaaaatggtgccgatagacttgattgagatagagctgccacaaaccttcaatttgtaaaaaaaaaaaaaaaaaaatgcaattatgttcaaagcacaacaaaatgatgtatgcatgtatgccatttccaaaggaatcccttggcagtcacattccccttggccagcaggtggcagtgcttgctcatcgaggtacagaatattgaccctgccttagcatcagggcccagcaggagttttagcttgctgttttacgctgcatgtgttctaattttctcccttttatatttcttattctgtgacttgttgtttctttcccaccacttctgttcccctccaatgctagacccatctctattatgcacctaacagcctcctcaaatatgtgccttgtagaatgtggcctttcaggaatgtaggtgaggcttacgtatcaccccctgaaagtcccaatgagaaataatgcatttaaaacaagccatcttgaaaagcctgaaaaattatgactaaatcacaaaatattaagtcctaaaggggaagggaagacagatactcagctggcctgcccatgttcaccactccaaacccatgacaggccgagatgctcagtgtgaggctctgttaccacactgggacttgccatggcttcagagtccttctgagcacagctactcaagaagcttctcctcctaacaggcaagcatgacacactctgccaaaccaggaagggcaagtttctgtaatagggtacactatatgtgcagttcccaggcattacatcctgcatttagctgcattccaggggccactggctaagtctttccacctttttctcttctccagtatgataacaacaatgcattaataatagcagctactattaatgagcccatgctatatgtgaggcaattcatgattcatatgcattatcacatgtattcttcaaaacaagatgaaaagtagaagttacacaagtggagaccacagactaggttaaaaaattggtcaacggcaaagtcacacagacaataaggggaagaaccaacattgagttgaaaccatctgactttcaaaaccttactcttaacctcccactcttttgaggtactccaagccaccacatgttctcccttcagctgctaaaagtggagcaacgccatcacccccatgtccacccacacccacaatttccctttgccaccccccactcatagctctgcagatcagatttggcagccgatctgctgctctggaaaggctgtggtcctttagttcagggtcccatctccagcattatgggaaagaggccctatagtacccaggtaggcaatcagcccagtggcaaagggtagctgggcttaaggcgagggacctcacaccgccagcagggctgcaggagcctggtggacttgtggcatgtggggaaacccgaagggaggcttagaggtggcatgtcccctgattcagagctggtgtttggcgtctctgagtcatcagtaattctccacaccctgggggagggcaactcctcaaaggacccataaagaaataaattctcatctgagtggctgttgaggtgagggaaggggtcaggtcttctgcagcctgggtgaggtatatgaacaaaccattcttgcaaaaactggcctggtttctctgtgagagcactgtcgagagatgtcacattcctgttgctttcattatgtggtgcattcccaggtctgatgaagaagaaagagaggggcagattgccatgatagttttggttgactgcatcactaatttcattgacctgaaaaatgggtagccatggaaactgtggaaggcttgttctggaagggccctactagcctagtgttgctatatcttttgtaacttatgttccagaagtcttccacctgtgggttacaaactattaatggatcctcatataaatttagtgaatctcaaccaaacatttttaaaaaggaaatatacaagaatcaaatacaaatgagatatcctacagcactcctcatgttgagtcaagtaacctttgggagaatttttgtttccattctacacagttatgagtacaccgagtcacaatataaaatgtgttcttactgtggctgtggtcaaaaatgtttgtaaactggccaggtgtggtggctcatgcctgtaatcccagcactttgggaggccaaggtgggtggatcacttgagctcaggagttcaagaccagcctgggcaacatggtgaaaccccgtctctactaaaaaaaacaaaaaaaaaagagcacaaaaattagctgggcatggtggcatgcgcctgtagtcccagctacgtgggaggctgaggcacaagaatcgcttgaaccctggagacaggttgcagtgaaccgaaatcacgccactgcattccagcctgtgcaacagagtgagaacctgcctcaaaaaaaaaaaaaaaatgtaaactgctgctaacccaaatctcaactttaccgaaaggaaagttccccttttttatttttccagaatttatagcactaaatgcccataggagaaagcaggagagatctaaaatcaacaccctaacatcacaattaaaagaaccagaggggctgggcatggtgactcacacctgtaatcccagcactttgggaggccaaggccggcagatcacctgaggtcaggagtttgagaccagcctgaccaacatggagaaaccccgtctgtactgaaaatacaaaattagccgggcgtggtggcgcatgcctgtaatcccagctactcaggagactgaggcagaagaattgcttgaacctgtaggcggaggttgcggtgagccaagatcgcgccattgcactccagcctgggcaataagagcaaaactcagtaaaaaaaaaaaaacaaacaagaaaagaaaaaaaagaactagagaaacaagagcaaacaaattcaaaagctagcagaaggcaagaaataactaagatcagaacagaactgaaggagatagaatgaaaaacccttcaaaaaaatcaatgaatccaggagctggttttttgcaaagattaacaaaatagatagaccactagccagactaataaagaagaaaagaaagaagaatcaaatagacacaataaaaaatgataaagaagatatcaccactgaccccacagaaatacaaactaccatcggagaatagtataaacacctctacacaaataagctagaaaatctagaagaaatggataatttcctagacacatacaccctcccaagactaaaccaggaagaagtcaaatccttgaatagaccaataacaagttctggaattgaggcagtaattaatagcctaccaaccaaaaaaggcccaggaccagttggattcacagccaaattctaccagagctacaaagaggagctggtaccatttaattttttgatagagaagtggtaaatcatgaactaggctgaaataaatcaaacttagacatatgcgaggaaggggacaacgctcaggaagattcctacctaccctgaagaattccagagaaactagaggcatgaagaaggggaagagtgaaacataggaatgaaaagagtcaagtctgtcatccaacggatggaagtttcagaaagagagtatagaaatagcacatgagagaaaagtgccagaaattataagatactttatctgagccaaataatacaagtcatcatatggatagagtccacagagtagccatcaccttgaaaataatttcttatgtctagacatattgttacaaaatttcagaacatggaggttcaagtaaatttgcaacagcctccagaagggaaatattaaagcaaaacaaaacaaatcaaaacacaggtaacccataaagtagcaagaatcaaacttgtttcagcaacactggaaactagaagaccatggaccaaggcccatggaccagggaccacacctgagagagaaaaagcatatgccgtctctttatgtacatatgaccatgggaaatttcatagaaactcaaagttctgccggaagtggtattcaacctagaatttttttttttttttttggagatggagtctcaccctattacccaggctggagtgcaatggtgcgatctcagctcactgcaacctctgcctccagggttcgaacaattctcccgcctcagcctccctgagtattgtgcgtatgagattcctatgttcaatgagacttgcttaaatttgccttaggcctgagcaacatgtctcccaaacagaaagaatttactctgcctatagttgggcaagccctttggaaacataaacataatgatttgaggtaaatgctgcccttctccacatgtaaataatacccattgcattgaaagagctttgatttatatttattatacattctgtcttctagaaacacactagttaaataacaataaattcaagcaacatgaaaaaagaaaagattttttaaatcccatgaatatatttcttttgtactattttaagaaaattcattcattccattagaaataataataccaacaataaaaatacggtggtcggggaaggagttccattttcagttctggtagagcagcttatatcacaacaaccctcccactgcaaacagctataaaagctacgtaaaatgcaaagaacatcaagaggcaataaaagaagtcaggacttttgaggcccaggtcctaagagtaataatatacattgagatgggtgtggccttttttgtttttccctgcttagagtcagatttttatggataaataaacaaacactgctggggttttgattaggattaaagaataccattaatgaacttgacctaattgatgtatgtagagcaatgcactgtataattacaatatatagtcttctcaggtgtacttagaaagttaccaatgttaaccatattatgaacaatgaaacaagtttcagaacattttaaaggagattatggtcttcgcagagaatagaattaaattaactatcagtatcaaaatgataaatggaaaaatcatttaataaataaaaattagaattgttctttctgttataaagaaattgaggctgtaattcaaaacctactctcataacaaactccaagtgcatttggctttaccagcgaattcgttcaaatatttaaggaacgcatgaaattacaccaatattatatatgctcttccctaaaataagtaagttttgctacagctggtcagagtgtaaactggtaccataactacttcataaactatttggcatcctatactaaagttaaatcaatgtaatcttatgatctagtagctttacctctatgtactcataagaaatgtgcatatatatttaccaaaatgcattttcaagaacattcataacagtatttttaataaatgtcccaacagaagaaacccaaatgccattaatagaaaaataattgcatgtgtatattcatacaaatgaaatactatgctattatgaagataaattaatcactgcttctcaccacaacatggatggatgaatgaagccagccacaaaatagtacatgcagaatggctcaatttaaataaattttactttatataaaagtcacacatagctaattcatggtgaaagaagccaataacagtgttcacagaggataataactatggagaggcccatataactcagttttctggtaacattttttcttgtattaactctgcaaattgaatgttgtattaatagtttccatcagtcaaaatagtgaggttctcttatttctataaaatactttcagtttcatccatgttgtttcaatgacaggatttcattctttttatggctgaatagtattccattgtgtatatataccacattttcgttttctattcatccattgatggaacttaagttaattcttatcttggctattggctattgtgaatagtgctacagtaaacatggtagtgcagctatctcttcaatactgacttgctttattttggatatatacccagtgatgggattcctggatcatatggtacttctattttttgtttttttgaggaatctccatactgttctctatagtggttgtactactttacattcccaccaacagtgtacaatcattcccctttctctacatccttaccattatctactattttttgtctttttgattaaagccattttatctggggtgaggtgatagctcattgtggttttgatttgcatttttctaatgattagtgatggtgagcatttttcatatacctgtttaccacttgtatgtcttcttttgagaaatgtctattcagaactgtattagtccattccagcattgctataaagaaatacctgaggctgagtaatttataaagaaaagagatttaattggctcatggttctgcaggctgtacaggaagcatgatgctgacatctgcttgacttctgggcatgcctcaggaaatttacaatcatggcagaaggtgaagggggagcagacacatcacatggccagagcaggagcaaaagagggacgggggaggttccatacatttttaaatgcccagatctcgtgagaactcactcactatcaccaggacagtacaaaggggatggtactaaaccattcatgagaaatccatccccatgatctaatcatctcccaccagaccccacctccaacattggagattacattttgacatgagatttgggctgggataacatccaaactctatcaagatctcttgcccattttaaaatcagattatttgggcatttttcttgatgtgaatactttattaaattaatgaatgcaaaccacctatcacagaacctactagtaggtgatgttcgaggaatattggttcctctttccatacctatgtggtcatcttgaaattgtgtgacctccttcacataagaactgggcaagagaatttggataatttagtgcagtctacccaaaaattcttaacaggaactccaagcacgtatctgcagggcagcagcagcaacagactagccattctttccagggcttcttccatagctaaaactcaaagaaacatttatgcccatgtttccaaggaggaacatatggccagacatcagccatgtgttcctccatgttctgaaatatagaaaaagataaacttcccacatgatttttttttttattttgcctcgttttgtcccttagacttgacagttgtacattttatctgtggtaaaggggatgcattatttacttcttcactcagtgaatactttttcagagatttttctctttcatatgaagagcacccatcccttattatgtgttaatcaaacttaatttatattctctctcagcattttttgtgtgtttctaatatatattaaaatgtgacaagaaggtgtttgaaaataaaattctcattccattgtggtatatatacacaatggaatactattcagccataaaaagaatgaaatcctgtcattgaaacaacagggatttaactgcaagtattttatagaaataagagagcctcactattttgttacgggctgaattgtgtccccttcaaaatttatatattgaagtcttagcccctaggacctctgaatgtgacttaatttggtgatagaatctataaagaggcatttaaattaaaaggaagtcagaaggtgagctctaaactaatatgaccttataagaggaggaagttggggcacaggcatgtacacacagaggaaagaccatacagaggaaagaccatattaagataaaggaagaggatgaccatctacaagccaagcaaaggggccccagaaggaaaccaaacatgctgaaaccttgatcttgaatttgtagcttctaaaactgtgagaaaataaatttctgttgtttaaaacatccaggctgaggtactttgttatggaagccctgtcaaactaatgcaacaacatttcctcccattagatttcttaattcgtgtatagctggcctgataatgtcttatcagctaccccaactcaattgctgcaaatacatttttaaaagttctggtggttgtagttgattgcacacttctgtatgagccaataatgtgaggcaagtctttaaaagggtagcacaatcagtctgaggttacaccatagatatggttaaccatagtgtggtctccataacataggaagtcaagatcccccttcactcttgaccagtcagattgcacctagaacatttttctcaattctgcataccacatttaaagaggaagacaaaacccatgcgttgtgcagctaccacatgtcgagcatcagactatgtgcactgtgtacacttagtcctcccaccaacccaatgaagatggtattaatacccacctcccattgtacagatgaggagactggggctaaatgaggtcaaataggttgctcaaggtcttatagcttgttagtgcagtggtcaggatttgaacaaattctatgtaagtttatcatgaaaccactttgcaagaaaagaagggcaaacagggtggggaggtatttggctactgagccacctgggaagtttggcaaaggttgagtgtggttcatctaaataaaaggaaccaagaaactctttaaatgtatttgagggactcttgtctcgaaccaagaaactcttgaaatatatttgagggaacaggatcaagcaaggacagctcttccaattctcccatctcttctacattctcttaattcatctgggcaacaacctggtcatccccatcccctacaaaaccttcccaccggacatctgtacttctcctcccatggttaatagcctcccctacaccctcaactattctctgaacatctccacaacttcatggccttctttcctccagaagaccccatggcctacagacagctaagctacagcagttggctctccaactactctacatgccatgctatgagagtggactaggctatgagagttgtttttttcctagctcctcattgacatttctatactttcaatccttccactgcatgcagatccctgtgccccactgaggtgtgggcctctcggctctaattccctctgcccctcctttgtaatgggggtggtccatgtactgctgtgtcctcacatgagttgctttattaagaactcgggcactgcattgcagcctgcctctcctcgctaacatttgccatctttctgggtgacttcagtggatccaataccctgcctcagtcatccttgacttcctcattcagagatcttcacctccatggactcccatagccacactctgaaccctgtcatctctcagaagtgcactgcttctgaaatctgcatctcatacacccatcctctgactaccacctcctgttccctggcttcctaattcactcacacccaagatgactgtccttcaacctcatcaaactttgagttctttttgactctttgactttgctcccatcttgtgttcacttcttggcattctactcatcttagactcagttcacttctgccattttcttgcacaaatcctgaattctctcatgcagtgcccttctgtaccacctgcaggcaaaaaccaaccctgatcaactcaattgtcctctatacttgctcgtgggtgggtaagaaaagctagaaaagctacccacagactcctaccattactgatttatgagctccaggctcaactgggcccttatctgggcctggaaatcattttgcatttctacagtcaagtctcctttctgaacaaaagatacaacattgaaaactgtcttctgtttcctgaaatgtctactcactacctcactttcaacagataaccttgccctctctttcacaaaggaaatggaaaccacaaagaggaagtccctcaccctgctgtccccagccctacaaatcctcctgcatctgcactctgctccttccctctttttacagagaggaggcccctcctgtctaaagcaaattccatttccttcctgccttgggctcagaaatctcaccccatccaaaatcttccatggttagcctgtccctttgttgcgactctttctcaatatttacaagctcctatattttttaaaataataaaactaggtcctcctggtgttcacatgttttcccaattgtagccaagtcctctcattcttatcacagcctcagacattttgaggtgtctcactacctcacctcaacccacaacatctggcttccctcattgttttccagtaggccccttactggggtcactgtcaacttcttattgttaaaccaagggtcacttatcagcccatttttatttacactcttggcatcaaatgtgtagtacctgagactccagtagttgccaagccccatagttgcagatttgcattctcttccctgcctgccttttctcttctctatttcagacccctcttcttctgctgtccttcaaaccaagatctccaagcagcgttcttctttggggcatcctcctttctaactgctgcactctcttgtgactttgtttaccttatccttatccatgacacccatacctatgtctccaggccagatggccagatgtcgttattggactccacctttatgcatccaactaaccagccaatatgtcccacttagagatggtccctgcccaactcatctaaactcaatcctgtgaaaagctgtattcattctctttctccacataatggttattcttgctgtgcattttttccaggggatgacattatcattaactcagattcccaagccagaaacctgaggccagccttggccccttcctgcctctcagccccattttagcttattattcagtcaacaattcatggaaatattacttttgagtctttccatttctctttcttgccattctctgtattctcatctaattcacatcactaatatctctccatgtggtggtgtaatgtgtatttgctatattctttcagaatattcaattatgctgtaaaagacaagaaaataaatgggatgaatgaaattcatacaatgtgctaggcaaagatgactgttgtagtcaggtctgactgccataacaaaataccatggactagattgcttcaaaacagaaatttatttctcacagctctgggagctagacatcaagattagggtgccagcatgggcaggttctgtgagtgccctcttctgggcttgctattgactgccttattgctgtgtcctcccatgacctttcctcagtttgtgtgtgctcaatgtgaagaaaggatttctctcacttttccttttcttatacaaccaccaattatatcatattagagctcaaaccttatgaactaatttaatcttaattacttcctaaaagccctatctccaaatacagtcatattagacatcaggacttcaacatatgaattttggaagggcataattcagcccatagcaataaataacttattaaccttgaaggcatgtaagataagtgaagtaagtagaacatatatgtgtgaacatataaaatgatggaaagatcaaggaaacactaatacttattgatatatgtgataaatatacatgaggtacagggggcacaccatttttacttcaggaatgtgaagcactctgtatttatgaagtcttaatttggccacccattggtgacacccatcttggtcccatgtgtcctatgcctaagaaatacaattaagcttttagctgttcagcagccttattagcaagccacaactgtagccaggtgtacttgtcttagcatctctcagaggacagtgcatgtcactgctcccaagccccttccctctgtggaccccatactcaaacctcaactctggtgtttataaccataccattagcaaggaagactgactgatgcaacagagagaaaggatgaatgcccaatccataccccaggattcaagtaaagtagttctgcttttttgaacactgtcctacatgtgtgaacctatctcatctctttccctttgattattgctgtgtgcattaaaatttacttggtaaatggtttgtgacctctgggatagtttgcctggtgatttacttggaggctaccattgcatcaaggtaatttcccacgacagatggattgtattaatgatctcaatctttgacccttccctaaatgtacaccctttgctatgtgactttacagtttcttcaatcaaaagacaaaatgtgttttcctgtcctttgaaatttaactcagccatgtggtgtgtcttgcccagtggagtgttagcagacatgatactagcagaggcttgatagaattcttgtctgcttgggcttgcccacctgaacctcttccatatctatgcgaaggatgtgcccaagcttgctcacttttcccaggaggaaaataaaacacacagagtgtgaagccaatcttagccaaacccagtctatatgactctcagctttctgtagatgcccagacaaaccaagtttagattagccatctatcatctgatctgtatgctcatgagaaatcgtctttaaatgttgttttaagccactgagtttggggtactttcttatacagtaatactcacttagacaaattctgtagcctcttaacttgttttcctgctacattactcccctccaatctatttcttactgaagtcattgtgctcttctacaacacaagtctgattaccttatttcctttcttaaaccatttgatgaagcttatatttatctttagattaaattacaaacttctgcataagcttgtccctgtttattcaactagccagcctcatttctccacctataaatttcaactatggtgaactatttatatatccttaactgagccattctctctcttacttctaggcctttaaacatatcattttctctataggggatatgtattagtttcctagggctgctataataaagtatcaccaactgggtagtagctttaaacaacagaaatttattgtctcatatttctagagtctagaggtctgaaatcaagatgtcagcaagatctcactccctctgaaacaacactcatccttgcatctttctagcttcaagcggttgctagtaatccttggcattctttgccttctagctgcagcacttcaatctctgcctctatcatcacatgatcttcttccctcatgtcttcacatccgcttcttataaggacaccagtcatgttggattaagggtccattttactccagtatgaccttatcttaactaaatatatctgcaacaatcttacttccaaataaggtcacattccaaggtactggtatttaggacatcaacatatattggggggacacaattcaatccatagcagaatactcttccaaatggccttttctggccattaatcctactcattcatcagatctcatccttgctatcagttttccttggaaatcattccttgtctccaagatctagttaagtgccacttaacttatgtatacataagatgtcatgagttgctgaatatggaacaattacattaaaaactttgatttagtggcctccaaattaatgggatcttattttattatgatcttattttattatgaatgtaatggtggtacaccgaggtttgatatgggctttgttttgtactagatatatatctctaaggcatattataaagccatattggaccagaaattcaaatactttcatgacttcctctcaattcctcattgctgtttccctttgtatatcagcattatgtgtctttctagatgcagacaagctttctttgctctttgtcacatagaaacttatggccattctgttgtcccccaggtgagtttaggtattactcacttgaggtattacagtcactcacaaggacagagatagggtatccaaaaattccaggtaaaataatctggtttgcccagcttagggtagtgttaaccagttaaccaaccagctatggcctgggataaggttatgcagttcaaacatgatttctgtgggtatgtgggtgtcagtgttctctgaaaaatgggatttattaactggtggttggaaccataccccaaatgtagtggtgttcatcatagtgtaattatgtaacagattggcttcgcctacttaatagaaatagtactaatgagtcagaggacataggttccattcccaaattagtaagggagattttcttggttcattgccaaatagcacattgagctatggataattgtctcaataacactttggtaagaatgtttccccattcctttcctggtctagctttcataaactatagagaagaaatgaggaatggggacttcacaaactccaagaaaataaagactaaaatttatttcctgatagaccttgacttcacggagggcaggaaatgcctcttatttatctttgtcttttttgtccctccccagaaactaaaacacttcatgggccatataaatcttctagtagaccgaattaaaatggactggaccaggccatttttaacttcagacacaggatgatttgaatactattgaaagcaatgtgtaaacaagatgtcatgggttgctaaatatggaaccaatacaatataaacttctcatgttacaccactaactacactgtgtattaattgcctgtgaacacttctgcaccatccactaggctatgagttccatgaagaatgagaaaaccatgtttgtcatggttaccactgtttccataatacctagaatggtagattgattgtagtaataaaatcaagtaatggcttttctctagccacactttacggctgcagctttgtgataccatctcactctgagtcattggccaagtgacttgctttggccaatcaaatgttagcaaatgtgatgcaagaagaggtttgaaaagctcacacctgtaatccccgcacttggggagactaatgtgggcagatcacatgaggccaggagtttgggaccagcctggccaacatactgaaactctgtttctactaaaaatataaaaattaggcaggtgtggtggctcacatctgtaatcccagctactcaggaggctgaggcatgagtatcgcttgagcctgggaggcagaggttgtagtgagccaaaatcttgccactatactccagcctgggcaacacagcgagactctgtctcaaaaaaaaaaagaaaaagaaaaagaaagaaaagaaaagaaaagctcatatatatttcctcttgctcttttgtaagatttggctcactcactgttgcatctttaactcatcatgagagtaagtctgggttagctttctggaaggataagaggaaccaatgaagaaaaactgaagccatcctaaaccagctaagaaccagatgcctttcaaacatatgaatgagttcagccaagatcaacagagccacctatccaacccaaagatgagtgcagatatataagtgaccctggtgaagaccaagagaactacctagacaactcatggacccaagaacaataatgcatgattaatattttaagccacgatgatctgcagtagtttctatgcaacatttttgtagcaatgaatgataaatatatctaaccctcaagatttgttccaggtgctcttttttctcaagcctctttaaataagttctctaacccaaaacagtagatcaattattttctctgcttgttttcatggagttctctcacctcacttattttaggctacatttatgttcatcatttcctataacttatcagttgatgggccttgaaactgtgactctctaatttcctacttgtctctcttttctcttttccaaattgataaatatatattagaaatacagtggccattttttctttttcttttcacacatacttttagcaagtttatttttcctcttaactgctaggccttatgtcactcttatccactcagtgttatgccaaagccattgcatacttggtcatgaaagctaattgctaaactttcagaaattttgtaaactggatattaaatataaccatctttgaaatctgccatggtggaagtatttacaccacagaaatgggcaaattctacaaatcagggctgcctctctaaatccagagatgcagttattaaacatgtactagtgtatgtaccattgtctataccatttatattttattgatgaaacccactcacctttcaacctctctcagaggggcagatgtactgcctgagggattagaaagctgagaggagataggtaaaggtagtagaatctctggaaacagaatataaaaatttgatttcctatgcatctgtgtctcatggatgcacaaatttctgcagcattctttctacagactgtcttaactggaaaaggcattatgtgtgtgggtgtgaccaaaactctagcatttactttcctcactggtgctgtgatagaaattacccaatccttagctgcccatcctataaagctccttcttgtgcttgaagaatccaccactgtgacagaagacgaaaagctgaaatatttattctctttgattcttggcagatggagcaaaagcagaaacataatgagatgcttccaggactttatatattgatgagaagtaggagagtttagaatcccattctactgccagtgctggtggtagatgccactgatccagatgttttcctttggcatcaccttggcttccctttattcttgccttgtttccccttctgtttctccaaccttcctgtcaatctatcaagacattgtgtagctttttgataagttatgttttgacagagttaatcaaaagttggcttctgttgtttgcaactaaatgccctgcttaaaacaagcaacatgctgagaaatccatgaaggtgccaccagtggatatgggagacatgaagtggctgttgatgccaccacctggatgtggtgcctggtttatgcagctagacttccactaatggattaactcagttgaaaggagtgtagctgactttcacattcagttatgctttttctataatattaaagctcttcatttaagtaatttaaataaaagtaaagtatgctgcattgaagaggatatataattttgagaaagatgtagtcactaacactgagagaaataaggcatatatttttttcattaatctttcattgttctccctcagagcttgacctaacagtttccacccatgacttttccttgagtactataaaattaagttaaattttcttggctattccttctttgactgattgtctttggctcctaaatcctttagcaactttgcaccaaaagcactagcaccatttatctcttgatttagaaacaaagagatacaattatgactatattttctcaatatctgagctaatattagaggaatagctagatctgcctcttcatgacatttagaagaaagtaagactctggatatcactctcagttttgtcctttcttttattgtgacaaaaacaaaagaaaatgtacttgatggcaaggtctttatgaaaatctcatgaaaatcttttggttttctattcaaagtgagttttgttacatagttaagttcattaatttcgctttgaattttaaagattgctctttgaatataaattaggttttctacaagtatataaaatattttattgtttccaagcaaatatataaaacaaggcacagtcagaaaaataaagatttgattaaaccaattttcttagatacctgctagtatattatacatacatttcctacatataacttttaaagtggtacctaaaatgaagctaattcacaaattaaaaaaatttaaacagtaaagaaataaaacagagaaattcaataaagacaatacttctgcctttaccctcacttcctgctttctctgagcctagaaatcagccagaggtagaagtttaagttcttcttagctattttccaagtatgtatcttgcccaggacatgtgtgtgggctttagttttcctagtctacatggaagcttttcaaagcccttattcacccaaggaatctcacaccaaagattttcctgccagagttttattgtgtcctttgtttgttccaaatgtttttatttatttatttattgccctagatgatagtggcttgcttttcaaagttttgaggaaggaacttcacataaccacttctctaccctgagaaagctccaaattaggtaaaacaaaattaagcaccttgtgtcagttcttcagggaacccccaaacagatcaaaacagacaaacactattctgctctgctgaaacactttctgctctgttgaaacaatatctgctcttctcccttcagaaccaggtgcccacaatcagaatgaagaattctgtctgaagatcactgtcccactgagaaggagtggggtggaacaaaagtaaaatgccacaaagctatcatgttgtgctttctcctggttgagcattcacttagttgctgtaaacctttcattatcttccagggtcctgagaagtttcatcctgattgcttttttcacagatttttcaatggttctggggatatacaggcccctagatttccttactccacctgtatgactattaggcagctcaggctgccataacagagtaccagagacttggtggcttaaacaacaaaaaattaggattattggattaggactccacctttatgacctcatttaaacttaattacctccttaaagatcctgtctccaattacagtgacacagaggattaggtcttcaacaaatgggtgtgaggagaaagggacaaattacattgtcttttttgctgacatcatcttgacttcattattattattattttttaataaaacgaaaacctttcccaacaatgctttaccctcctttggaagattattgaaggctactttcaaggaagtttggaagagctattatttgtttttcatcctttatattgaggacaacagaaaagaagggagatgataaaacatttggaatagtcaagacaatgcctgctatgctggtatttaacaaactaaactattctggggagatgtgaagtggagacagccagagggaatctcattttgactctagggttgcattgctcatgatgcctctttgatttcagctatttcatcaacatagtaattgtatatattcacctgagacccaagcattgctcataattgggacatattgctagctgtttcatgagagttttgggatctatagtcaaatgtgtatcataaatccatggacccttcaccaatttgatgggcatgtttcttttctttctttttcttttcttcttttttcttttttcttttgagacagggtctctgtcacccagtctggagtgcagtggcatgatcactgctcactgcagcctcaaactcttgggctcaagcagtcctcccacgtcagcctcctgagtagctgggattacaggcacacactaccatacacagctaatttttttattttttattatttatttatttatttattttgaagagacggggtctcactgtgttacccagactgatctcgaactcctggactcaagcaatcccccagcctcagcgtgccgaagtgctgggattacaggcatgagccaccacatctggccaggcatgtttcatttttaaatccaatcagcacttttaaaactgaaccacacttacaggactgatatttatccaattatatatagatatagatatttaaatttcaaaagcaaatagaaaattttaaattactccatagtcatcaattttttaaaaaaattatgatttcacttccaccaaaatgtttgcctgtgttcaaaatatttatttaatccatttaggccaggaaagtttagcaaggaaaatgggtgtagtctcagaattatatacaaatatgatttgagtctgaataccttcatttccttgaactgagggcagtattcacactttatgcttatagtttcaagttcagagtgtgcagatgtctttgcacatccatgagaaagtaaaatcttgtgattcatttgcagtcttgctgattgactttcttaggattctttaattactgagatactcagtctcagaaagcaattctgtaaatctcccaaatggccacaaatgaataatctcatattaaagtataataaatattcattatctgctttacttttttatgtccactataaaacaggctgatgaataacccctggtttaccaataggaagttgacagcaacctcagtaaggtcttactggagagaaatgaggggaagcagatgttgtgggttgaggtgagggagtgagatgcctcaaaatggctgaggctgtgatagggaagaaagagcttggctgggattaggaagacatgtgcacaccacaaggatctggtttcattttgtttttaaatagaagcctgtaaatgttgttgataggaagctaatctacttcaatttaggactagcttctgccttatcccacaagatgaccattaattcaaggttgatgttgtgttgtgcttgttaattagctttatgaagatataaacaacagaaagggactataaaacaggaaaaggaaaaccagcaataattatcgtgtatcccttttttccatgatcatcatcatgaacaggaaagccccttatcggccatatcatttcttgggacagatattctgttttattccgtgacctattcctaatctctgtgagaaccacttctatccaccatgacattctcttccacaaactccagagcaagcctcacatcaggtaacactgtaagtttctccacccaagaacatcaccctttcattttactgtactgagcagtttaactcttctctgactcaacctctaacccctagaccaggcagtgcctttcaattcccaaaaagtccatcaaagtgtctgccctactagaagagcagcctctcctcaaaactaattccccaattcccagagaaatgtgcacacactgaagatagcttctgaggtgttagattttacaaaccattttcttttaaaataatttcatgcagaagataaaggtattacaaagaaatccaaggtactcctgatccagattcatcaactattaacattttgtcacatttacgttgtcattctctctctctccatatgattatttttttctattttcttttttctttttctttctttctttttttttttctttttttttttttcgagacagagttttgatcttgccacccaggatggagtgcaatggcgcgatctcggctcactgaaactgctgcctcctgggttcaagcaattctcttgcctcagcctcccaagtagctgggattacaggataaggatcctgtaattacattgggcccacccagataatccatgaaaaactttctttctcaatagccttaatttaattacacctgcaaagtccctttaaccgtataaggtaacatatccacaggttctagagattagtacctagacatctttggttgggggtaatatttatccaactacaaatggatatgataattttacatacctcataaggtggttgtgaaaaataaatgagacaaagcacataagacatgtggtgtgtataaaatgctttgtaaatgtcagctgttgttaataagaccaagttgtttgtaaaaaaagatttttcaaggaaataagccaatataatacaggatgcatactgaaaagttttagttcaaatcaataactagagatttcctcatttttcctttattctgatgaattaatgtatacaagtcatatttaacataaaggggtaaaatgtaaatcttcatcgccagacattttcattttctattaagtgaaatgccagtaaaagccacattcttaatgcctttaattgcctagatcagtacactaacccttcttccccgaatacctcttcttctactttgttattttctctcccaaacaagagatagaacatttggatcccattccagcaaacttcttcaacttttattaactcttgagattctggtgatgaaataaaagtgagtttctttataccatgatttactgagaacccttcttgatataagcagtagaaatacaactggaactgttttccttaagcagaaagtggcagtggtgggaatttatggcttctgtagccaggttaaatacagtgatgtggcaaccaggtccaagatcttgcccaagatcactcaaggtcatcccagcttcagatctcctcgtgggattgctgaggccttattgtgaccacatgataactcaactgctccttctgcccacttctgctttcttatttttcattgccttttacagctatttacctctaagaacactccctaatgaaactcctgcacactaaactccatctcagaatctgcttcccaggaaacccaatctaaaagaataattgagaggtccaagtatctcaggcagatcagactcaataattcaaacactgtaatcacatctgtctccagacttctctatccttccctaaatactgattatgattttgtttgtgttgacataatttttatgtagctatttagcacaaggtggtccaaatggcctatggcagcatcaggcatacatcattcacaaagagagaaaagcttgactttctcttctccaaagttcctaaaactccaccccaccatgcaaaaaactaattggtcttccttgggttaaatgcccacccctgggacaaacactgagtccagaggaatgaagtcattgcagtagccatccttaggcaaggaatgtggggctacacaaatcatagaaggatatagagtgggagcatgatggttctggaaagaataggatacatggcagagataaagggaacagaaatccatttttcattagcacaaggaataaaactcattaagaaccttggcatagtaacacatctctctttcatcagcaatttcatacatgcaccttgacgtaattaggaacataattttgtggttgaaatttatttttattattgtgacagtctacaactactgtattattccatttcagaaattttttgactatgagttttaacctactatggaaagcataatattgaggtttataataaaaaattatatttgatttgaagtaaaaaggtccagagcacattctctcactaactggctataatctcaagaaagcaaccaagcttttctgaaacttagtttcctaagtaaaatgtggaccactggggtggagccaagatggccgaataggaacagctccagtctacagctcccagcgtgagcgatgcagaagacggatgatttctgcatttccaaccaaggtaccgggttcatctcactggggagtgtcggaaagtgggtgcaggacagtgggtgcagtgcaccgagcgtgagccgaagcagagcgaggcatcgcctcacccaggaagcacaaggggtcagggaattccctttcctagttaaagaaaggggtgacagacggcacctggaaaatcgggtcactcccgccctaatactgcgcttttccaacggtcttagcaaatggcacacaaggagattatatcccgcacctggctcagagggtcctatgcccacagagcctggttcattgctagcacagcactctgagatcaaactgcaaggcggcagtgaggctgggggaggggcgcacgccattgcccaggcttgagtaggtaaacaaagtggccaggaagcttgaactgggtggagcccacctcagctcaaggaggcctgcctgcctctgtagactccaccactgggggcagggcatggccaaacaaaaggcagcagtatcctctgcagacttaaatgtccctgtctgacagctttgaaggagtagtggttctcccagcatggaatttgagatctgagaatgggcagactgcctcctcaagttggtccctgtcccacaagtagcctaactgggaggcaccccccagcaggggcagactgacacctcacacggccggctactcctctgggacaaaacttccagaggaacaaacaggcagcaacatttgctgctcaccaatatccattgttctgcagcctccgctgctggtacccaggcaaacagggtctggaggggacctccaacaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctccccctccaaagggatgcagctcctcaccagcaatggaacaaagctggatggagaatgactttgacgagttgagagaagaaggcttcagacgatcaaactactccaagctaaaggaggacgttcgaacccatggcaaagaagttaaaaaccttgaaaaaaaattagacgaatggctaactagaataaccaatgcagagaagtccttaaaggacctgatggagctgaaaaccaaggctcgagaactaagtgaagaatgcagaagcctcaggagccgatgcgatcaactggaagaaagggtatcagtgatggaagatgaagtgaatgaaatgaagcgagaagggaagtttagagaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatatcatccaggagaacttccccaatgtagcaaggcaggccaacattcagattcaggaaatacagagaaccccacaaagatactcctcgagaagagcaactccaagatacataactgtcagattcaccaaagttgaaatgaaggaaaaaacgttaagggtagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagaaactttgtcaccaccgggcctgccctaaaagagctcctgaaggaagcactaaacatggaaaggaacaaatggtaccagccactgcaaaaacatgccaaattgtaaagaccatcaaggctaggaagaaaccgcatcaactaacaaacaaaataaccagctaacatcataatgacaggatcaaattcacacataacaatattaaccttaaatgtaaatgggctaaatgctccaattcaaagccacagactggcaaattagataaagagtcaagacccatcagtgtgctgtattcagggaacccatctcacttgcggatacacacataggctcaaaataaaggtatggaggaagatctaccaagcaaatggaaaacagaaaagggcaggggttgcaatcctagtctctgataaaacagactttaaacctacaaagatcaaaagagacaaagaagggcattacatgatagtaaagggatcaattcaacaagaagagctaactatcctaaatgtatatgcatccaatacaggagcacccagattcataaagcaagtccttagagacctagaaagacacttagactcccacacaataataatgggagactttaacaccccactgtcaacattagacagatcaacgagacagaaagttaacaaggatatccaggaattgaactcagctctgcaccaagcagacctaatagacatctacagaactctccaccccaaatcaacagaatagacattcttttcagcaccacaccacacctatgccaaaattgaccacatagttggaagtaaagcactcctcagcaaatgtaaaagaacagaaattataacaaactgtctctcagaccacagtgcaatcaaactagaactcaggattaagaaactcactgaaaaccactcaaccacatggaaactgaacaacctgctcctgaatgactactgggtacataacgaaatgaaggcagaaataaagatgttctttgaaaccaaagagaacaaagacacaacataccagaatctcttggacacattcaaagcagtgtgtagagggaaatttatagcactaaatgcccacaggagaaagcaggaaagatctaaaattgacaccctaacatcacaattaaaagaactagagaagcaagagcaaacacattcaaaagctagcagaaggcaagaaataactaagatcagagcagaactgaaggaaatagagacacaaaaaaacacttcaaaaaatcaatgaatccaggagctagttttttgaaaagatcaacaaaattgatagactgctagcaagactaataaagaagaaaagagagaagaatcaaatagatgcaataaaaaatgataaaggggatattatcaccgatcccacagaaatacaaactaccatcagagaatactataaacacctctatgcaaataaactagaaaatctagaggaaatggataaattcttcgacacatacaccctcccaagactaaaccaggaagaagttgaatctctgaatagaccaataacaggctctgaaattgaggcaataattaatagcttaccaaccaaaaaaagtccaggaccagatagattcacagtcaaattctaccagaggtacaaggaggagctggtaccattccttctgaaactattccaattaatagaaaaagagggaatcctccctaactcattttatgaggccagcatcatcctgacaccaaagcctggcagagacacaaccaaaaaagagaattttagaccaatatccctgatgaacattgatgcaaaaatcctcaataaaatactgacaaaccgaatccagcagcacatcaaaaagcttatccaccatgatcaagtgggcttcatccctgggatgcaaggctggttcaacatatacaaatcaataaatgtaatccagcatataaacagaaccaacgacaaaaaccatatgattatctcaacagatgcagaaaaggcctttgacaaaattcaacaacccttcatgctaaaaactctcaataaattaggtattgatgagatttatctcaaaataataagagctatctatgacaaacccacagccaatatcatactgaatgggcaaaaactggaagcattccctttgaaaacaggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcttctcagcccgaaatctccttaagctgataagcaacttcagcaaagtctcaggatacaaaatcaatgtacaaaaatcacaaacattcttatacaccaataaaagacaaacagagagccaaatcatgagtgaactcccattcacagttgcttcaaagagaataaaatacctaggaatctaacttacaagggatgtgaaggacttcttcaaggagaactacaaaccatggctcaatgaaataaaagaggatacaaacaaatggaagaacattcaattctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctgcctgatttcatactatactacaagggtacaataaccaaaacagcatggtactggtaccaaaacagagatatagaccaatggcacagaacagagccctcagaaataatactgcatatctacaaccatctgatctttgacaaacctgacaaaaacaagaaatggggaaacaattccctatttaataaatggtgctgggaaaactggctagcaatatgtagaaagctgaaactggatcccttccttacaccttatacaaaaattaattcaagatggattaaagacttaaatgttagacctaaaaccataaaaaccctagaagaaaacccaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacagagggctaatatccagaatctacaaagaactcaaacaaatttacaagaaaaaaagcaaacaaccccatcaacaagtgggcaaaggatatgaacagatacttctcgaaagaagacatttatgcagccaaaagacacatgaaaaaatgcccatcatcactgggcatcagagaaaatcaaatcaaaatgacaatgagataccatctcacaccagttagaatggtgatcattaaaaagtcaggaaacaacgggtgctggagaggatgtggagaaataggaacacttttacactgttggtgggactggaaactagttcaaccattgtggaagtcagtgtggcgattcctcagggatctagaactagaaatactatttgacccagcaatcccattactggatatataaccagaggtttataaatcatgctgctataaagacacatgcacacgtatgtttattgcggcactattcacaatagcaaagacttggaaccaacccaaatgtccagcaatgatagactggattaagaaaatgtggcacatatacaccatggaatactatgcagctataaaaaaggatgagttcgtgtcctttgtagggacgtggatgaagctggaaaccatcattctcagcaaactatcgcaaggacaaaaaaccaaacaccgcatgttctcactcataggtgggaattgaacaatgagaacacatggacacaggaaggggaacatcacactctggggactgttgtggggtggggggagtggggagggatagcattaggagatatacctaatgtcaaatgacgagttaatgggtgcagcacaccaacatggcacatgtatacatatgtaactaacctgcacgttgtgcacatgtaccctaaaacttaaagtataataaaaaaaaatgtggaccactgggcaatcactgggcagtcataaagataaaataacatatatacatgaaagtgttacgcataatgtaaaaagcttatagaaaaaataatcatttctcaggtatgaagctacattttaataacctgaaaatattttaagtaatacatttattatgcatatattttcaaagacaagaatgatgttattgattatggtaatatgaaggttacctcagattgttaccactttcaacctgctcacaatgtaaattctgttatcaataactaataatagaaaagaacatattattatatattcctgttaaacttttcaaatatagtacacgtaactctgtgaacaaatcttccctctagggcgttccctagaaagtcctcgatttagctagcagtgtttgcaagtttgcattttctctaacaattcttaatcaatcaccatcatcatcatggtcatatcaattgctaaacatgtcctgtgactatgtgatagtccaggcatcaatctaaaatctaaaaagatttgtgctttacaatccacagtgaaagaataaacaaggcaatgctttaaatagagtttttttttaaattaatcttttctttatatcaacttggatataattaggcaaaaattgggaaaatatgtgtcatatctaatatcagtttctcacagtgccaaattaattaactagaataatggtgattaaactctatagactacttgattattgcagaggaatataatttttaatttaagctttcaagaataaatcttagactgcaaaatcagggaattttctggatttgggtctacttctcttctctcatttttttctcaaccagagatgtttgggatttcaatcacaagtgtgaggatattggacattactgcataatgggtatggtgagtacttccttatgttcaccacagtctagtttgctactaacagcttaggagagaatgaaagccaatgagggtgggagaagataaactgttagctaatgcatacaggttcagttttcttcatctccatgtctagtcaatgcctttcaactaatacctgttactctttcatcaaactttctgcctgcctttctaagagcagtgcacattacattttacttagccagtgttctcaaaagggaagttagtaactttctgtaaaagaaagactttactcttcattgcaactgatctctctctctcccactgtaaaactgattgaggtgcttaaggttctcaagaaattgctactcatagccctgtgattacttttataaaggcgggggggaggggaaatcagtagaatggaatggttgattactcagggaaaagattctttcttttttgaattttcttctcaaattatggagggaaggaaagggagtgggaaaatgttcaagaaataagtttatgtgaaactgggaatgttatttcctggtatatgcagattaatgatccctttgtcattgcctccccagcagagcacaggcttcaggaggcaggtggaaaagtatgagaaaggcttgaaaatttaagtgggataaaggaagatgatccaataggcagagaaagagaacagtggggataagtacagaggaaaagactgatgagttccaagagcttatggtgaagcagtcatctttgtagaggagtttgagagtggcagagatgaggagagaaagtggatttttaaatatgttttatttttctttgggtataaaggcctcacttctttgaatacatgaaaaaaataagtacagatatgagtaacttttttgtttcagtcaaaaaacagaaaccactgtatttcaacagggggaatttcataccaggaaatttgttacatggattatggaaaagtagagaatcccaacatggggtgcagaggcaacataatataaagatgaacaactacaggaagtggttaccaccctaggggttagagggaaactaggaggtggtggtgtaacttgagttcagaagccagggccacctggcagaatcttgagctacagtggtgatggctaggactagctcatgccacagggggagaggctgactggtgaaagttggagcctcagtgcagatgcagccccttcatggatgccacttaaagcagaaagctcagggaagaaacactatggcttatctcctgctatccattctccaattcagctaaacatactagaagccagagggccaaggagcctggcaatacaattttctctgaaacacagtagagcaaggaaagtggggaatagacctgagagcaagaggcaaataattggcacatgttttaattgtctaagtgtgtttctttgaattcatctctgtgtggaacagaaccacgagactaacttctctttatgtggtttacacatggtctaagagccatagcattctaaaaagtacctttccttgaatattaagaagtgaaaaacactactactttgctaattatcgtaattacagaagcttcccaagtagttcatggacaacaatcaaaagagtacttatgtcttttttttccttcttttgttccctttcactcctcccatttcttttttttttacctccatattagctataactgctgtacaactacccttgtgcaattagtcaatattgatctcataatggggttactatcctaccttcctgtctctttcatgtcttgaagagtgggtaccaacaagggaaatgatgctacatttagcttttggcatctaccatatctgacatatctttgtgctgaccctgtttactcacttagcatataggatgtcatgtttgcctggaaacatgattgccatctaaacattttggtatatttcttgtattttgtcatgttttcctatagttgtatgtggagtgatttaatgtagggtttttagtgtaggcatagtaaggcttttttctagtatcttggtcaaaagtataaccaaatttcttgggttttaaatcccaactctactatttgctagttatgtgaacttggccaagtaactgaactgctctggaactcagtttccttatctgtaaatataatcataataatagaatctgctttacagtggttgagttgtgaggatcaaatgaattgatgtgtgtgtgtttgcatgtgtgtctatatgtgtaatacacacatatatgcagtcatatcacttaactatgggggatttgttctgagaaatgtatccttaggtgattttgttgttgtgtgaaaatcatagagtgtatttacataaacctgatggtatagtctactacacgcctaggctacatggtatagcctatggctgctaggctacaaaccttatcgttttttattgtactgaatactgtcagagattctaacacaatggtatctaaccatagttaaccatagaaaatagacaataaaaataaagtataaaagattaaaaatggtacacctgtataaggcacttaccatgagtagagcttggagaactagaagttactctatgtgtcagtgagtgagtggtgaatggataggaaggcctagaacatttttgtacactcctatagattttatgaacactgtacacttaggctatactaaatatgcaaaacattttgttttttcaataatgaaataaatttagcttactgtaactttttatttataaacttttgcttttttaatttcttgactcttttgtaataaccctaagcttaaaacaaaaaaaattttacagctgtacaaaaatgttttaatatccatatctagaagctttattctgtttttaaattttttatttttatattttacctttaaaacatttttgttaaaagctaagacacaaacatacacattagcctaggcccacacaaagtcaggatcattaatatcactgtcttccacctccacattttgccccactggacagtcttcaagggcactaacatgcatgaagctgtcatctatgacagcaatgcattcttctggaataccttctgaaggacctgcctgagattcttttacagttaacttttttataagtaggagtatactctaaaataatgattaaaagtatagtctagtaaataaatgaaccagtaacatagtcatctatttttactatcaagtactatgtaatgtacataattgtatgtgctatacttttacaactggcagctcagtaggtttgtttacaccagcattgccacaaacacatgagtaatgtgttatgctacaatgtcactagatggtaggaatttttcagcacacacacacaagtatatatattatatattatattatatattatatatatatgtatatatatatatatatatatagagagagagagagagagagagagagagagagatggagtcttgctctgtcgcccaggctggggtgcaatgacacaatctcggctcactgcaacctgactcccaggttcaagtgattctcctgcctcagcctcctgagtagctgggactacaggtgcccaccaccatgcccagctaatttttgtatttttagtagagacggggtttcaccatgttggccagattggtcccaaactcctgacctcaagtgatccaccccactcagcctctcaaagtgctgggattacaggcgtgagccaccgtgcctggccaacaccattataatcttatgggaccactgtcatacatgtggttcatcattggccaaagcatctgtatttatatatgtatgtttcaaattatatatatatatatatatatatatatatatatatatatgatagctatacatgaacatacacacacacatatatagacatatatagcacataaaattggcacatattaagcattttgtaaatatcaaccattacaattgttactacttttctcagcaaggctatgaatgctgttccagcctgtcaaaatcacacctgtttaatgtgttttacccagcacgaagtcatgtctagttgagtggcttaaaaattgtgatcaaatagctggttagttaaaaagttatttcactgtgtaaaatacatcccttaaaatgcactgttatttatctcttagttgtagaaattggtttcattttccactatgtttaattgtgactggatcattatagaccctttttttgtagttgttgaggtttaaagatttaagtttgttatggatgcaagcttttcagttgaccaatgattattagccaatttctgataaaagaaaaggaaaccgattgccccagggctgctgttttcatttcctcattggaagaagaagcatagtatagaagaaaggcaaacacaacacattcaacctctgccaccatggggaactgggctgtgaatgaggggctctccatttttgtcattgtaagtaccaacaagagataagttataaattctctgacttctcggggttatcttggaactaaaatagaccaaagcttttttgttcatttgaggaattgtgttgaaactgatttaccatgtgaacctatatctatctgtaaacagactgagtccattcttccaaattccttaatggaaagaacatatctgggggctcacttctagcttacttctgaattcctaggaggaataaattagccagcatttcgcagaaggagtagaaaatatttcatgctaatgatctctgattctgagttgtttagtaatgtttactcagacgcacatgtctatgtgtttatactactttaaaaatgacaaattgaaattttataccattttctaaataaaaaatataagattgactcatgtatgggaagtaggcctttatttcagtaattacactaaatataataaaacttctcaaatttattttcaaaaacaagtaccttcttttttcagagatctaaacttgagttatttataagatttataaaaattcaaaagaacagaattgaaataagtcatctagattcataaatatgtagtatgtatatttatatataattgtatatatatataaatcaatatagtctggagaaactatgtaagtaaagatatagctaatttacaagtggacagaatgatttctgtactttttaaaacaaagaaaatcaactgttctcttaaaatggtgttatcagcaaagcaataatggacaaattgggtagatagaaatacgatttttaaatagcctttctaaataaccaatagaagcattacacagatgttaaaaagtacaattatgaatggaatatgaatggagcttttgtaaaaatttatcatgaaaaataatgagtctttgagttttaaatatagaaagcaattagtggcacaaataaaaacaacaaatattttgttataaaaaatgtttacgccaaaccaacattctactgcaacagagaattcttccgagtattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttagctgatgagaattcactagctggattactgtgtggtagagggaggtgattagcacctgtgagaacagaacgcagtgtcatactggtggagggaaagcaatagtaatatgttcccttcctttctcattttaagtggagtggcctgctatcagctacctatccaaggttaagcaaaagagaggggaaaaaaagggagtggggtaatgtaagactgataatttggtatactggccaaatcataaaacaatcatggggaacaacacagggtggagaggttttaattatagacaagtgtagtgacactgttgaggaaagagctggctctaagctggttatatccagctttgtcactacctttgtcaaagttggacttggggaagtcctgacccttatctgactccagtcttgtgtggaatctactgtggaaatgcggaaacttcatgcaattatttctgtttgtgcagctggtttggctggggttgaacgtcttcctctttgtctggtattaccgggtttatgatattccacctaagttcttttacacaagaaaacttcttggggtaagtataaattccatcccatgcaatattggctggttcacatttctcatcagacattcttgttcatcttcctgttagcattttaaatacatattctgaccaacccaaacagtaccattagcctcactccctccattgcaacttcctgggcaacagtcacttaaagccttccagtctgggaccaacaaaagtggggcagagggccccagtggcatccttccccaaccaagaaccatgtgccattgtttagcttaaaggagaaatctaatactcactctgaaatggaagggcaggttggagcaatccatccaggagtgacacatgtgggacaagtgggactttccatattttctaagtcacctaattcctagtacttttttgcatgaagagctctgctcctaatcacatgttatgaaatgatcttcagaaaataaatctctctctacatataaagactcgaggaacttgctcaagggccacatctgttgactaggacagtagagtgaaggcccttcagtttccttgggtcctttagtattctgagtttccttgaactgtcaggcctcttgcctccagaagacatctgttacatcatgctgaaactatgaattaattgcttaatattaattattataagtattataaatcataaataaataattttagcatataattatgctagatcattataattgttgttagcttattcacattgatgctttctcccgccaaaatatgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagttgatggatggatacaggaatggatagatagaatgtgataaagcaagcataaaaggtataatctgggagatgaataaacaggtatttattgtaaatttccttcaacttgtctttatgtttgaacattttaataataaaatgttgaattagggcaaaaggtcaatttcagatgaaaacaaagggtcctagctagccctaaaggaaaaccgttggctctgaaggaccttcctgtacagatcacttggtgtctctggtgtgtggcctcatgctaagaaccttggggaagtggggacagggcatattctgtgctcaaaaaagtcactctgctccctttcccgcctcttctagtcagcactggcactggccagggcccctgcagcctgcctgaatttcaactgcatgctgattctcttgccagtctgtcgaaatctgctgtccttcctcaggggttccagtgcggtaagagaaaatgttttactaagttcctctaattttcaaaggccatcaagcaaaatgcccttttttaggtaaaaacaaatgaatgatttgggaggattccagcttctgtagaatactcatgagccaagccattatctagtatatttctgtgctatttggggatggagctccctaagacaactatttggaaaacaaattttgaaaaaacacacaaaaccacctatacctcaacagtagcaatgaagtagcacacacgtacacgtttacacacacacacatatatatatgatagatatgcatatatacagagctttaggaagttgacatgtgatatctgggagttaatctttcagtgtcattcaaaaaaatttaagtcagaggaaatatcttctgtggataatatctcaaggagatggagtcaatggacagagtcacactataatgaatgtaaccaagaagtgttggcttcatggaactggggagcatagagctttctaaatgtccagaattcctttgactctcactccaacaatttagtaagccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaattggcatagccttggcttctctttgtattattattataaatatttttttgccacctgtgaccacaccaaagagggtagctgggaaaaaagtagggattggtgtcctggtgggaccaattccgtggttcattaatgactagtagcttctaggttttttttaaaaaataaaaggtatagtaagctttttgaaaaaaatacttattaagtagagatcacttatggaggacagcagaaagcaaactacttttgtgggaatgtagggattgtacagggcagatgcctgacataaggctggagaaaagaggtaggattttactggtaaactagaactgcatatgtatagttgaggagttcatgcttaatttggcaattacagaatatttgaaggaggcagtgaactaaactgtaataacaagcataacttgccttgaactctgcctcatttttcctagttacactaaattcatgctgatccagagaatttttttctttaagaacatataacattcaatttactaatataggactagaggctataatttagcttttattttatgacttaactatttacaaaataccatttcatcttaaaccaactgccaaaattgggctctcacaaatctaaagtacaagttggcagaaataactgttacaccttcgcttcctcagaaaaagaagaatgttgataaccaatttaagatgttccagaaagagtcgtgatatcttcctctgaaaaattctgtgatgaggttcctttccttaagccataaattctatgctacgcaatgttgtcttgcaaactgagagctaaccaaaaccaaaaactaacaacagtacttggtattaaacattgattacaaggatttccaaaaaatcttccaaatttaagaaatcacagaggtaaaattacactcaattgaaagttttattaatgagccacctattgtaaagtataacgtttaatatatcgtaagtgcccagtgaacatttgctaaatgaagcccatgcactatagcttatttttgagttgggttctctatcacccaggctggagtgcagtggtacgatcatagctcactgcagcctggaactcctgggctcaagtgatcatccctccttgacttccatacatgtggggattacaggcatgagtcacctgcctggcgagttccttgtttctaaggagacacaattcatttttattctccctacccccattagaatagtttctatttagaggaagtaaagcctgagaaacaggcaatgttttcaccaagatggcctgttaagaaatcttggttagtctacaagtccaaatttcactgccggtgagcaccatgtcccatgagcagcacatgttgtaatgccagcttttatgcctcctgtgacccaggagggaagatctgcatgagagtctctaaagacagggatgaaatgagactgcccttcaaatcgcagagaagcttggctgtataactacatagatctttatataaaagaatatgttttaaaactatcagcaagcaacattcttttatagatcaagcatgtactttcttctgggattcctaacctgaaatgtgaacttttctaataaaacttcttctgtgattgtgattaaaatgagtgagtgtgctgtaactaatgttggaaatcatatagctgccactcattgaagcttaatggaattcaccgcatgaaatctgcacatcaaaccagtaaagtgggaacaaaattaaatggaagtgttggcattcaaacccaggtcattgtgtccccagagcccattcactttaaatcatgctgccaaaacttcttgaaattgtgctgttgcagtattatgatcctagaaagccattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataaggataggactatgaagacagtgtatgttccacaacaaaaccatattcgtttgctttaaattcggcgtgcaggagccagtgaattttccccaaaaaatttcaaaaggatttgtcaacaaatagaaaagaacagtgtgtggcaagtatagacatgggggtaaattcatctctataggtttagtatgatcatctccagttccagggcatgaaaatgtacttcatttatgcagccaaataatgattaaaagatttttttaagtacatgacatactgtttttcacacaggaagcttacctgctagctggggagtgcagccttactaactgaaaacttaaataatgatactaaataacatcaaatattgattaaatacctgtcaatgaatatatgcaatagggatttgagggactaactatgataattatacaggtgaggaaactggagactgagtatgttgttcgatgtcacacggctaggtgggaggactgggacccaacataggtatatctgaagacaaaacttgctctgaaatgtgtaattcagtactgctttccaaccctactaattctcattctctgattctttggactccaacctagtttcaccactcctgtaaggactgtatcaatcatctatcgtgtaacaaattaccacaataacttaaaacaacccctgtttattagtttacagttctgtaggtcacaagtccagcacccagttgctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgctggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagaaagagaaagaaagaaaggaagaaagaaagaaagaaaataaataaataaataaataaataaactataaaggaacatggcaattgggaaacaggaaaaagttatttcctcaaaattttaaggaatacaaagtagaaaataattttcagcacttgtaatgaacacaaaagacaaggaggctatataagaaaacaaagatggtcaacttttcaacaacagatcagtaaaatgtattttacaaataaatttttatttcaaaaacattaagtttgaaaatttgtattttacaagtttttatttcaaataggaaaccattgttttgagagtctgagtcattgctcagctccactggtgaacatttaattataaccaatgcattggtgctccaccatattccctaagcactggcacttccaatccatgcgacaactgccctttgcaagcatcattcactctctgcctggggattttctttcagctttctcctggggcaagcctgaaatcccaggggattgatgtcctgagagcatccctcagagcagccctcagccaatcatggatggcagttggtggttgaacacccaagcttcttaacccgttaggtaaaaaccaaagaacgaaacaaacaaagtaaatgaataaaaaaccctttgggataagttctacacagtctcccagagttccctggtgtgatcgagcccaatgatatgatatgatcatggtagctgatataataatgcactcttcattaatttccttcccagtctcatttttaccctcgttttctatgaccaccttccggatagaatacttacacttaaattcttgtcacaggtttctaggcacttagaataatagtgactatattcctgcatttggtttggtagaaaagggcattaaccttttatagacaaatagacttggatcccagccaatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattaaacacccctatatttaaattgaataaaacatttagaaccaaatattttaagtacataaattttctttggtacttcactctcttgttcttaaagttccctgaatctctgtgacagtgcatttagactatggaacaaagcaaccagagcaagacattggccagttttcaggagagccaagctctaattcaaccataaatcagtttaaatcagtttttttctttctttgagcattggcacgaattgagattcaaactcacattttctaacatatgtaggttcgtcaaatacactaaaatactgagtacaatagtatttttaatgccaaaggaaatcatgtaaagtatgaaatatcagaatgtttatataaactctagtatcagatggcctgagtttaaatcccagctctgcaacttattagctgtgtgacctaaggctaggtaaactctctatccctttgttttctcatctgttatgtagtaataataatggtacctcccttgtaccattattgtaagaattaaagagttaatttgattattacattaaagattaaattaaattaaatattacatcaattacattaaagattaatgtaagaattaaattagtcaatgcatgtaaaacagttgcagaagctcttggtaaatgttagctattgttattttggctattagcatttggtcaatgatctcccctgtgatgttgttcacctacatgggcaggtgtacccttctttctcctctcatagtgtgtatgtcctagaacagtgttgtttgaaaactattcacttgttctagaactgttcacttgtctgtgtccccacttgactatgaggtatgtgatgttaatttctacatcctttgtttaatgagtaaattaatcagaactagaaactatgtagctagatatgttttttgtacaagtttatatttttatacagttaagcaatggattccagaggagactttatgtcaccagtatgagaacagaaaacataccagttaagccagccatgtcacttactggctgtttgacctgaggaagatgactgcatctctctgaacctcagtttcctcatttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctggtaagtttattaaagaaaacttggaaccagggagttccctctattcatagatacctttttatataggagatcaaccagttttatagttagattaagtggtggttggatatgttgtatttttttaatgagttttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcatgtgtgaatttgtggactttttgcagcaaacctacaggagccatagcccataaattgagaatccctcaagacggtcattatcagctaaataccttcattattattattactattgttattgttattgcatgtatccatacaatggatatatatgtgtgtatatagatattatatgttattattaaaattattagggtggtagtgtcagtgcaagaagggctgtatttgggacccttatctaattccactaattcactcaacaaatcattcatgtgccagagaatatataagcacagtgataaagcagacttgtactctgcccttaaaaagtctgttcctagcctgagtaaaataggcttagattacaggcatttaactgagtttctcttctactagtagatctggcaggcttttttagcagtggcaaataaatagttcaaaagaaatatatgataaaatcttgttagaaactggcatagtgtacggattaagagcacatatttgcgtgccagaggtactggatttgattcttaactctgctgcttcctagcttgatgaccttgaacaaggttttaaagcagtctatgtcccagcttcctcacctgtaagatgagctgatattaatagtacctacatcattgagtcaatgtaaggattaagtcattgtgaagtacttataacagtacttggcatctagtaagccctatgtaagtgtttattaataaagaatgcaatttttaagacagagagattcataccttatggccataggtttgtatcaattcaatcaaatttgtcatctctctctggaggtaatttcagagtcaggttaatgggccagcaattaggcattcactacatgagtgttttcttgtttgagcccaaatatattatggagagagataatgagagcatatctaaacaccttcagaaactaaggctattgtgtagaatcttataacttgattgagtctttaggagcatatagctcaacatcttcatcttacaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaaaaagttggctaaccatcagagggacaagtctgtaggttacaataatgggagtatagaaaaaaatgtctcccacactcctcacctcatgtgtggaggtctctagatgttttccaggtctttaagctcatccatgagaatgtgtgcatgtgaagcctggagtaactcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttagaatttaggattctgttagatggtttgggggaggatttaagaatgcaaggattttctctggatcagttatggtcaggaattgggggtagttctcagataaggtatcttaattattttttctaggaggcagagggaacagaataggactaagtctataataggcaaagaagcagtagtcattgtctaggctcagacatgattttggagtggttttgcttttatctcactccatcacagtcacagagtgacctcctcagaagctggtgttttgtgaaattatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacattattcattgtttgcccaatgatatatgagggtggcaacattaacataactaggtaaatctacactatcatgctctattcagttgttcctggatcacttttactgtatctatgctctcctactcttctaaatgttttcattttcaataacctgtaactgtttcctcctcagaggactgccctggggctactaaagtcccttttctcacaggctcagagatcttggaaggttggtggggggtggctgaatggttacctgttcctgtgcaaaccgttagccaataactggtggatgcagactatgaaacctggcttccttgccttgagacaggataaactctaagttgtaacttaccctccagagttgccttgcaggatcaggctgaagctatcccctgtgagactgcctgatttcacccccttgcttgacttgtttgtcttttctatcctattccctactctcttaccagtttctcttggagcacatgttttctaagtcacttgcccatgaagtctcatctcaggatctgcttctggggagcacagctgatgatgttcagcattcccagaatatatttgcaaactaagcactgtggccctttcaaaatcaaagggagaaagagccttcagacacttttaggacatcctgtagttgattgatttcctttattttctacccccttagaaataactatttaagtacatcagttcacatttcctatgacatcttaaccatgtaagacattttaaaatttagaaacatctatttcaaatctatatctgtctgtgagggatgattaggattattcaaagagggggtgaaaatatctattgttctatacattggacactttataatagtcctgcatttgagaacctataatattgtgcttgcgcacatgtgtgtgtgtgtgtgtgtgtgtgtgtgtgtgtgtgtgtgtgtgtgtttatattttacagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattctgaagtgaaggatttcatgtccctcaatttctaggcaggatgctccattagaggcacagtgacctccttgcctgtgtgtggttagcctgtctgctaagggaatgtgagaggatagcagaggtcagtttgatagaaaccagtcaacattggcatttttgtttcatgcacccatgtaattgctattcatggtgaagttatatatagcaagcttgaaaaatacaccaaagtctgagtatctttgcaaatgtataaaacatattgagagcactggtaggatctggaacatctgcaatgatatcctctatggtttaatcactagtaaattaaacaaacctccagactagaagagttaatgattaatcagttgaagaggtttgttatagttcaataagttttgatttaagcccacagtcatttatttgttgtctaccatgtatgaggacctatctcaggcactgcaggaaatacaagcaggaaaaatatgtggttgttgccttcaaacattctaatataatgaaagtagcagctaacttctattaagggtctgtgctaagggtttgacatgatatatttcttttaacccccaaaatgtatagatttctcactatcaccatttcttggggatagtaattgcagacaagaaacctggagctaaaatgttaaaatatgcagcctaagccacctctctggtaagtggcccagctgagattggagccaggcagtctaaagcaggctgtgataaatgttctcttagagacacacagttcctggctatgtggttaggagagtttgcctgattggagatcctctttcataccaagtttccttttttgtgcagtttcataccacctgcacacaaaggcaggcctggggaagttccctggtgggtatagggctccaggaaattagggttggaggaagtagaagctcaagactcactctgcccagagcccagttggtggccaagacatgactgtgaaaaaggggaagggtggggaaagctgcattgggcactgcattcttaaactacttgctgactgtgacccctgataaactctttgtaagcatggagaaatcaatggagaccaagaatctgatgactctcttaaagcactcaaatatctttaaatgggacttagtcataatcccgtgtttcaggtaatcctagagaagagaaataatttcttcccctctccaatttagtaattccaccactttctgtttgtatggtttcgcagatactcatcttcctttgaagcagacagaggagatatgtttatctccttctccacttgaagagaatctgctctttacactggttaggtgatttctcacagtctcatggctccgtagcagctgaattgggtttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccaagcctggcacatgataagtgctcaatacatgataattctcttccccaagacctaaggatagaaaggagtggttaatgaacttgaattaaaacattctcagaatacaccaaatgacacaataaattttaggtctccaaaacaaacctttacaatgggttttctgtgtcttttcttcttatatattctgaagatgctgtcatttatgttccttgaagtctactcaacgttgggccttcctctctctatcaccaataattgtcttatgatttggtagttgctcaactagcatttattgaattgaaatgaatgggctctgagcaattcaaggtacacactattagtgttgatgtctgtgagaatgttataatccctatatagttaagtatctcaaactggtttcaaaatttggtttgatttagataatttccaaacccacaaataaggcacttcttgtaagcttcagggctactgtatatgactgtctcagttgtctactatagtgggtgcctggccaaggacaataaagttagcccacactttgatgattgagccctttgcttatatcttcataggaagggtaccattttctaatttgcacaaaggcactgtaggggccagcagtcactctgttagatttgcaatttttctgcttttgtttgtttgtaaatgaaaatgatacttgagacagaagtagaaattctcccttaagagaatttgatccaacacttaccctctataatgttacatgtaaatatccctttggtaattgcacatatattttttctgttgctgagtgttatgcattttctttcctttcatctattcagagggagcaataagctatcgcttttaagtgaaaagtacagggcctacatcagagcacttaaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatggtatgtacaattcattgttgttattacagtttcattactgacaatctttaacctgtgtctaagaaacatgtacagatgttatacatctatatagatgtccattacaaatgtcatggaacagctaaaacatgtgtctacttttctctgctatacttattggatagaattgtttcttgaaaactaagctttgcattgttctgttattaacatcctgatataaaacttgggaaaatagtgtttttagaagtgctgttttggttcaagaagttccatctcttttcttcatgacgacgccagctaatgatttttagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgtggtgggcagaagtgtggcaagggtgaccaaggaaatacatggtgaaatactttcttccttctattgggagctctgaagggttccattttgtgtattctcataacactgctccatagagtaagatgtgggccttgtaatcttcatatcattttccccattggcagatggtatactttgttggttattgtgctagccattggtataaaactaggcaaaaatcaacatttgtgcagggcttctgaagaggattatttttttttccttaggcacagtataacataaaggcaaattttccattccattttctcctttcttttttcctactctcttagcataggagcactcttactctagacacagcatactatatgaagacgtaggatctttaagcatcttttcccattaatggaagcaaccagacatatcagtgaattggctccactacatgcagacatcaatagaaaggataaaaagggaactgtattgccaatcctcttgtgggcaggggaaggcacatttcctcgatgacagctggagtcagagtactagtaccttagcagaaacctacctcaaagaatttctaggtatactagcagcaatatccaaatctggctccattcagtggggctccatggtagcactcaggaaacagatagatgatttgagactgttttatatatctatcccattaaaacaaaggccaacaacagaacattgtttatatttggggcaaatattcttcaagtttggctgaagatggagagattcaggtgctctcaatttccaacagtaagtttcctataaaagtaatctagtagaaagattatatgtgagactatcggaagcactctcttatcttttcccccttagaatacattccggaaagtcattttttagataatattgctgtctaaaattctttgctagtttaggtattaaactagaagtccaattggctgagtttcaggatggatctgtttgacctcaatgtttttatatggccaataatgctacagagtaattccagtgttcagaaacactgcatgttctgacccaagaaatagctaaagaagtctgaaaagctctaggtttgtctccattcagcaagtgcattgcatactcccagaatttctcagaatattggagaaacagccaaactcttgcataaaatttgtcatcttgcaaatttgtcactgtgactacataactaagagaaagcaatcacagtgttgcattaaaaatattgtgttgctgaaatgttatcctttaaagaaatgttaattctgaaaccaaccttgctttgttatagggttactgcaactgtagttgcaacactgagaggaaatcccattcttgtgaggagttcctcttgggaaagttttatcttgtcagtacagttccccattgtgactaaggagaatgtttacttttactggctcaaaattatcttagtttcagatattttcatatattccattgtagaagaaatttatttatctaatgtcaaatatttaagcaagcctacaaagattaacttggcttctaaaatttttctccctctgaatattttgttatctattaccacttaatgtatctcattttcatttttgctctgattacagacttggaaatggatagtgggtcccatgtttctgtatctctgtgagaggttggtgcggttttggcgatctcaacagaaggtggtcatcaccaaggtactgattggtttagtaattactagtggtcagtgtctaactatatcatggacaagtcttcccaactcctctatatcattgatcagatgttacaacagagagaagacctacaatttatttcaatttacttagctcaataatcaaatgtttgagcctttaactggggaaactacaagttaccatttttgatgttaaaatgaagccaagttctttctggacatcaatctcccccacccattgtgtgtgtgtgtgtgtgtgtgtgtgtgtgtgtgtgtgtgtgtttgtgtctgtgtgtctgtgtgtttgtggaggggaaggcgacagaggcattatttggttagttaagagcagaaaagaaaaagaggtgagttcaaaggggcataaattgagtcttaaaattttcagatgccaaaagaaccagagatctaagggtaggtctcactgaggctgagctagtttttcaggttgtctttaccaccttttctgtgctgtgtatgtaataatctaataggaaagttgaagtgcccaaaatttcaacaagttagtaaataagctgcctctcaaatttgctctcctaattccaagtctagagtggcttttcctgaactctaatctgtttctcatcacaaaataaataaatatccaactaaataaatgtaaatggaactccttgttataatttcaggaaacactaggaaagtctatctttatcaaataaaatttaattcaattcaactcagttcaaaaagtatttgccaaaaccctactgtgggttatttttgcaaaacacacaaattcttcctgtcctccaccctatctttcctcatttgctgtctatggtgggtcatagtaaagttagttcagctggctttggaagtcttgaaatataggaaaccacaacagttctccttttgtgatatttatattgcattataagaacaatcccacagatcagcaaaaacagttgctgcaaaatttcccttactagactagagatgactgagtcagacaagtatttttcttaaacatacctttaaggaaaacttgttttcctttgaagaaaatagatatttgttttcttctcatataaataaatatgagaaacaagatgttatccaaaagtattccaatgagaatgctgtccacttatttagttacatctcatttgtgcctatgatagcaaaattgtaatatggtaaaaattttttccacaacacaaaattgcaacatggtaaacaattttcaacataattttaattttctgttttcaaaatgaagctttacaactccttatttcagaacagaagggaagtttgttatagtttttatcatgtaagatgcatttaaatcacaagttctggaaacgtttgacatttttttaaaaaagaatttttcactcttccacaactccctgttcgagaaaagcccagcaatatcagttaacattaggaagctgctattttatttctattgatttttctttcctttgatgtcccttggtttgtctttaattatacatataaggttcttctagaagtcttaggaatcatcaaagaaacagtatattactttctgtattgctcttcactgtgttctattttttaaaaaaattatccagtcaatagttgatggacatttggattgtttcctgttttttgctattatgaataaagctgttataaacgtgtgtacgtagacagatgaggatggcaatgggtgggtagaaaagatggtgtactccccaggtagggagaaatgtagaaataacgcatggaatcaggcagattcaaggtgtgattcaggacaaagatagaccaacttagttagtcttgttttggggaatgttgctacataactagtcaatgggatctccttcttctggccagctattaggttggtgcaaaagttattgcggtttttgccattaaaatatggcaaaactgcaataatttttgcaccaacctaatactaaggccctctctcatcctcttgggggataggaaggctgagcaggaaacatcagtttttgtaaattttttagcacttttttgacttctgagaggaaaaaaaaatcacaataggctgatttcttatgttggattccctggtaaagactgagaaataactgcatgcagaaggtttctaaggaattctataagagataaacctggaaaggaagtaagaaaggcaggaatggggagagagaaaagctgatcctctttctagttgtaactgtggcctcagctgatactacagggagtgtggaaattgagatggcctcttggagttaacctaagttaaggaaaagggactaggccttagtatcccttaatcagcccatcattagtaatgggctacaactgagggcaattccctgtgacagacacatctgctggaggaactcctgtgttgtccctaaagcagagatctaagtgggccaatttagctcagttttttatccatatggacactaaaaaggcaagtatttaggaaaaatgtcatttccagacatatgttttattctataggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagtgagtaaaaagtacatattaccaacgtatatgagttcaggaaaaatggcactaaatagctcctcttcctccatgttttactaagtctccaacaaaacacacaggttctaagaatataggtagctatttctgtggtcaccgtttcatatgtgtagtgtgtttatgcatattttcataaatcttatgtgaaatatgaaaaccttgaatcaaatattagaaataaatactcccaaattcctttaaatatgtaagggtcaaggccaagttatattaactttcctaacaaatataattgtagtgtatcaaaaatattcttaaattttcattggcataatttatttgaggttaaatgccatatattagcccctttgcctccttttccctgcatgcctaacatgctataaggcacttagtaggtgctaaagaaaggtttgagagtttgttgaataactcaatgaatagataaatgaaaagtggagacattaaatctacaagatgtaatgatgcagcaaatcctcacttcagggtgcaccgtatgcaagaatttcaagagtgggatgtcctggcaagacatagggtgtgtgtggagggggcgttgttgtgtgtgaagaggggtggggagattaaaaaaaaaaaaaacttgttctgagttaccgaatgtttttggttagccaaatatttctctttttacttccaaacccaacgttggcactaagtttggttacttgaaagctatttcatagaaggaagcacccaatagatacattattccaatttgaattaacatgttgcacatccccaataattatgggtgccccatctcactctgaagagcaagacatctctgtaactatctcctccccatttcccttcaggatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaaggtaagtcctttcatttatcggagggccttagagcagtaaccatactctgccatgtgaggcctgagagtgctttcagggctaaggttggcagagaccatgggaagtgaagaaaagcttccggtggttccagagagacaggcttttcttcaaaagaatatttgttaaatctaatgtgcttctagataagtaggcctattagtgaagggaatatattgtatttgtatagtgttgctggaaattcagaagaaagaaagttgggaaagtattcacagccccaacttaatagctgtaatttttgtatattctcttctaatattttccatgtttacatatttttagaaggttgtaaatattaagtatgtataatttcatgtcctgcttttaaaaaaacattatagaaagtgtttttcaatgtcttcacaggctttataatgatgactttaaatgatctcttcatgttctattgagaggatattgaataatttttctttcatcttgtgttagatactgagattgattcaatttccagccgcgccccaccccctccactcacccaatactttttttgcaaagggaggagaggagacctgaaactctacttatgaatatctcctcaggatcaattcacaggagattttttggttacctataaatttggttttattgtgtaataaagggcatcctaaataaacctcaggccattctaataactgtaaagataaactctaatagggacattaagcctaccttgacttttcattctccctgtacctcttttccatgtggaggagatgtgcatagaaccttatttttcccctcggaactcatgaatgtctggcagtagcagccagggaagaatttctgtggcaatccctgctagtctagattccatcaggctttctgagaagaggttcgaaggaagccagagattctgggagagtaagagcagactcagagggaaatttggtgggctaatagttttttcttaagttgtgtatttctgaggtcaagttacttatttactgccctgctagagtgaaggccagagcaggttcatgtaaactaccctgtgaaatgtccagagccttctgaaaatctatgtttctaggcattctgagcatcaagaaaaagtttaggtgacagaaagtggaattccacatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggtgtgtcttgtgtactattttttctaagtatgtttagtggatttggtgatccggtccattcactctcatttagtatcgccacattatatttagactgctcagattagaatcaaagccaaggagcctgtgagggaataaaagccatcactttgacattattagagcaattctcccaccaggcactctgaaaccaggtgattgagatgatgcacagggttattttggggaaaatttagctttctctttctctctgtctctctctctgtctctctgtctctctctctctgtctctgtgtgtgtgtgtgtgtgtgtgtaaaacagacactccccaacttaataatggttcaacttatgatttttcaactttacaatgaagtgaaagcaatatgcattcagtagaagccatacttcagtacaagccatacttcagtactgtattcaataaattacatgtggtcttaaaccttttattataaatagggttcatgttagatgattttgtgcaattgtaggctaatataagtgttctgagcacatttaaggtagtctagactaaactaactatgatgtttattaagttagatgtattaaacccattttagacttatggtattttcaatttagtgatggttttatcaggatataacaccattgtaagctgaggagcatctgtttatataacatacataagcatataaaggattctgtatatatatattttaatatgtatttatatatgtatcatatatatttatatgtactatgtatatatgtatttataaaatcatttaatttatatgcttttgtatgttttataatatactcactacatttataattattatgcatatatattgccaggtattattcttatgtatctagtcacatagattgtctaattttatcatgtcaccaaccctatgaagtagctcttattattttccacactttacagatgaaaaaactcagaccaggttaggtcattttcctaagagcacccaacaagtaagtgacagagacagaatgtgccagagcctgtcctttcagcatcttgcagtagttcatgattatcatttataaataaattactatatatctaatgaatgtgatatatatgcatgtatgtgtgtgtgtatgtgtgtgtacaatgagagtgctctttcaaaaatgtttggagaccactataataaagtagccaatagttctcaactgggacaattttgctctgctcctccccaagacacacaccagagacagttggcaatgtaaatatcctacaattaaaaagacagccccccacaacaaagaattatacagtcccaaatatcaacagtgctgaaattgacaaaccctgaaacaaggtaatgattcctggagtggtaacatctttgtaagtaagcaaacgttaatgacttggcctggaagcagcataagctatcaccatgagtgaggagctaaggcaagagtctctgcatatttctgtccagtgtctcagctggtgtcttagtccatttgtgctgctataacaaaacacccaagactgggtagtttgtaaagaacagaaatttattttctcaaagttctggaggctggcaagtccaagatcaagacaccaacaggtttggttgtctagcaaaggctgcatcttctgggtgggagaaatactgtgttttcacatggtggaaagaaaaagggaaggctcgtcaaatactgtgtgatgactcttttccaaagcccttaactcattcataagggatgatccttcatgtcttaatcacctttttaaggctccacttcttaatgctatcacataggcaacatctgaattttggagaggatacattcaaactgtagcaactgggcatacatagacattgactccacaaccctgggaatcttccatgtgcaccctgtcactgtgaagactgaattcccatttgggtttcaacatattgtttatcacagattctccaagtcttaaaggaatcttgtagcaaatatagattagggaaacataacgataagaattgttgctccataaaaagtggtttcaaaatgccagttctgcaatttaaaaacaaaacaaaaatgctttgataaaaataaaactcaggaaaaaaatctatagtatataaattgctttactgttctgttattttaaaagccatgcacaggtttcttttttaaatcagttatttatttgtattgaaaaagtaattattttgctttgcaaaactgatatctatagaattattaaattggagtgcccacctttcttaacctcctctatgaccatcatccatctagtgaatttcaaatctgatttgctttttaaaaataaatttaattaaccacttttatgaaaaatacctgttgctcaaactgaagcctcctagaatggtagcagaaaaacagtatgtgactatatacacatatgtgcgtgcacacacacacatacacacacactagctttaggcttgatttgatgtcttatgctaccaaagtattgctgcattttagtctaaaattgttacatctcttagtaattctcccaaaggagtggaagtatattagggtggagagaaaaagtcaaacatagagcagagagaaaaacagtgagacactattcatccatcaatgcctgactcaaatactgcggccctaacccttcccctattcttccacttcaccttccttctttgttctcattaggacgcttgtgcctccttcatgacacacatcataccctgttcgacatatgggattatttatatttatacttcgaagtctccctttctagactgtaaattgcttgagagagatccagtttatttatctttgtttacctttcagcatccagcagggtgccttggttagaatagcttgtgaaggatgtaaatacattgtatgtgcttttacagaatgtctcttttttttctgaattcatgtcctttcctgtaggccaatcactttgctgtgcaccatgatgaggagaaagatgtgatcacaggcctgaaacaaaagactttgtatggacggcccaactgggataatgaattcaagacaattgcaagtcaacaccctaagtaaggagtctgtcaccaagatgtttttgaggcttgcatctgcctaaagcggcagcccctatacatatctaaacttatatattttagaaactcaaatatgtatattactatataaagattgaattcatgcccaacagaagattccagatatcttcaactttaagaaggatctttaaattataccaaattacctggagattaattaaaaacaagtatttccaggtccccatctcagattttctcaacctgcctgtcccaagtagggccacagcttagttcttttctttagtcacctaaatttcattagtgtatctacttcttttaaagattcaatataatttatacatattgttaagaagacactgtccccactttcagttctaaaagcttctgggtctaaaatcttaagttgacagatgtctcaaggtgctttctgctctcactaaaactttagtcattataaaaccttgagggggatcccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttagcttgttcctaatttcaagatgccagggggcacagagccctgaaggaaagtagcccacggactcatgaattcaccaccattttctctgtgatagaagtttccaaaaaccttggttggattttacttttgccagggaagtcaactaccttttgaactatccagatgctcacacaaacaggctgaaccacactccctctgagcaatatgatccctttgctatttgtggaaaagaaaaaggagcagaggggactctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttctttgtgtctgtgttactgatctttgtattaaagggtaaattcagctagtaacaattttctctaccccggtggggttgagacactctgtgtttctgtatatgatatgccaaacacttcatggtttatggattgggaagtgaaagctgaagactaagttctgtgctgaatactgttgatcctcacaacactaatataagggacagggagggcaacttaatgtcatagacagaatttcagaaacgaagaagccccagtgtgacatctttgttccacgtctactgaactttcatgttctaacttcacaattgagtatcatcaattgtgggcaatatgggcaattgtgggcaattgtgagcaattgtgggcatatatgctcatgcttctgtgatagcccttgttctaaatgagtcaaccggttacgatctccactatttaggaaatgcataggggtgtgggcatgacatgttcctgtgggagtcaacaggtgctgccatggagggaaaggacattacctaaaataaatggcagtaatagaaatagccaacatttggtaaacacctcctactatgccgaacattttacatacactttatttaatccctcagcaacactacaaggtagccgttttatcctaattttgttgataagaaaacagtctgaacgaagatgaatgagaaggaaaagtacccataactattgggtgactatgtcaacattcaatccacatctttctggggacaaactccatgtcctttatactacactagcagattacactaggtataaaaaattaaggatattttctttctctctctctctctctcctttttgtttgagacggagttttgctcttgttgcccaggctggagtgcaatggcacgacctcagctcaccgcaacctctgccacccgggttcaagcgattatcctgcctcagcctcctgagtagttgggattacaggcatgcgctaccgcgcctggctaattttgtatttttagtagagacggggtttctccatgttggtcaggctggtctcaaactcccaacctcaggtgatccaccggcctcagcctcccaaagtgctgcgattacaggcatgagtcaccgcacccggccaaaaactaaggatattttcaaagcaattatgctaggtacaaattatgtaccaagaatagctgggtaacagtggtaacataaatctctagtttataccatttaagtagcttggtatcttagtttagaaacactggttaatctgattcatgctcatttttacttttaaattatgataaaatagaacctatcaaaaaatggaattattttgcttggagaaaagaaggctgtagggtgactcaataatatttattaagtctactttttcatttatatttattttatttataaacaatttctgtctttcagagaatggccagctgttgtctatagttttgtgtgtgtgtgtgtgtgtgtgtgtgtgtgtgtgtgtgtctgtgtgtaataagattgcatgaggaaggagctaaatttctcaaccataaattcagttgggcaaaaaacaaagtgttgacagaggctaggaaatctgaccactagagatttttaaaacctggaaaaatgatcaaccaagtggcctgagattcatttaaacttgtagcctttattatcttgttgtagtggttggggaatgaggtagtctaagtaattggatattccagttaatacttattgctaatagattcataattttcaaggaagtgggatgctataaattataagaagaaactaaatcctgaaatacacttcttcttggatttaaaaaatactaggaaatgttgtacatgagcagaggccactgtgagcttattttctagattttactctgaagaactaatgacatgaagactgtgcttatctgacttttgaaaatagcccgaagtattttcttcctacttcatagaggactgctccaaagacagcaaacttgatttatataagaaataaagtccaaaagatcttcataaatcttaaaattacattcgattataaagaaatcaccaagtttagcattatgttagatcccttgattgctaaatatcacttcctcttttcagtaataataaaatcactaacctacttatgctcatagaaaacactaaacatcactttttctgatcagatgagggcaagtcagggcataaggaatgaaaacgacttcgttatttccaagagattctagggcaattcttagaaatctttatgtcgattgataagaaaaaaaaattatgctacctaaacatctcttgggaatagcaaatgtgcttgcattggctgaaaaccatcagggaacactattaacatgggagttattccagaccaagctattggagatcagcacagctatctgattatcctgttttccaggtgggggctctgcataactcgcggctaaaatatcacactcacatctatgttatcaacttcctgctgcattccttacccagtgcttattccgctgggacaaacatgcctatggctttactgagatcgaaggcaacagcaagcttgaccatgcccaactcacaaagaaagtcagatgcaaaacagcctttaagaacatgagtttttgcccttcctttatagaaaataatcacaaaactttcctttccttttggtaaatataaaaatgcattttgagaaattcatttcctctttgagatattgtttatcaaatggtgaggggatgggaatcgggggaaaatgtaaaacaaatgaatggtaaccatattaatagaaaaaacaagataaggaatataatgaatagtgtgttttttattgtttttttttaaacagtaatgcttgaattgattgcaaattggctcagatttccgacttctccctggatccacatcctctgcagtgtgactttgtaattccttccatcatgaggagtccttttgctcatcccttgaatctgggctattctcataacgaactgaccaatagaatgtggcaaaagtgacgtgtgagttccagagtctaggtctcaggaaacctagtgtgcttctcttctctcttttgcttctctaccttttccatacagaatgctcaggctagcccgctcaagggtgcaacctatggggcagagcagagtcagcctacttagtcccagccctaagaccccagatatgtgagagagagcccaagactaacaaaactgcccaggccatccacagatgactgtagatacatgtgtaagttcagttcacatcctcagaaccacccagatgtcctgtagatgcatgagaaatgttaaatgcttgttgttttaagccactaacttcagagtagtttgttatataacaaaaccgctgatgcaaatggcatcaaaaattgttgaaagagagatgggggttcagggtgagagctgtaggtgattgtatctgtgctaataccacatagcccttttttggggattgccatgaataatatattagctttgctatgagtaaaatactatatcctctgaattgtcatgaattacgtggagtcatacgtgttttggaagtgtgaaagtccctgggctcagataaaaggtgttgccatctggaaagtacaggtagtttatttcaattctgctccaataactagcacgtcattccattcatgtagaaataagctactggctatctcactatctgaaatagaagtatgaactgtgggtaagtgggtgaggacaatgtctgagcaaccaaaaaggagctcaaatccacaaacggtacattaaacagtggcgaagtcagtcagaaattcactcagagttgttgtgtacttgccataaccagcttagtcatgttggtcccaaagtcatagttgatgagaagtagcaagttaagagagaaagacttctagagataggtacatacacaatgataacaagtgacatcagagaacctaaggaagggcaaagaaagaaacactgcaaagcagactcaaacacttaaaagcatagcagcttggggccagttagtgtaagagaaaaggagctccatatgcctcaatagaacctaagagcatcattgtactgcatttattcattcattcacttcacatgtttattcaacaaatgctatgtatactgagatttttctctggtcattgtactggctagaacctaaaggagtgagactattaattagagtttacaatctggcaatgatattaacagtctattcacaaaagggttaactcaagttaagccggcctaaatgtttatgcaaaataggatttttgcctaagtctaaagggtatcagaaaagtgtagccattgagaatgactcatttcatggtgttctcggatggcttaagtattattaatatgtctccatttctagtgcaggaacctccacgttttagaggaaaggaggaaagaatttgtgaagactgtgcctaaaaaaggtagaaatttgtttacaatttatttaaagataaaagtaaagaactaggttgctttaaaaaagggagggaaagaaaatcaaaatacatcttatttgaggcattaaaacttttttaagaaaataaaatttaaaataaagttgtattcttctaaaaataattttttaaaccagctgaaaatgaaaaatgcagattatactaagaagcaactgttttacattctgctttctgaatggtatttaaaaactcagttattttcagaaatgaggaagtcttgatctgctagatgaaggtcggctgcaggtggtgtttattgctttatgatggcaacaaaccgtaaacccatcactcagtaaatattaaactggctgaatgaatccaaagcatgtctaacatacaggaaaaacacagccctgttaagcagtcttgaaacccacaagctacatggaaaacacagattcaactacatcataaaaattcagacaattctggttcaggatgaagaattgatcctaagcaattttctttctctctctctctctgaagactcttaaatggcattttaaaaataataatggggccaggcgcagtggctcacgcctgtaatcccaacactttgggaggccgaggtgggatcacgaggtcaggagttgaagaccagcctgaccaacatggtgaaactccgtctctacccaaaatacaaaaattcccgggcatgtggctcacgcctgtaatcccagctactcaggaggctggggcaggagaatcgcttgaacccgggaggtggaggttgcagtgagccgatatcgcaccactgcactccagcctgggtgacagagtgagactccgtctcaaataataataataataataataataataattagcatgtcttttaattagcatgttattattattatggttgccaggtgcagtggctcacacctgcaatcccagcactttgggagactgagacaggtgtatcacctgaggccaggagttcaagaccaacctggccaacatggtgaaacaccatctctactaaaaatacaaaaattaggtgggcatggtggtgggcaaatgtaatctcagctactcaggaggctcaggcaggagtaatctcttgaacccgggaggcggaggttgcagtgagccgagatcgtgccactgcactccagcctgggtgacggagtgagactcggtctcaaaaaataaaaaataaaataaaaataataatgatataacctgtgtaaagagaacagaagaggactatcgagaaataaaaatttttaccatgttcctagaagctggataattgatagagaagtggtaaattatgaattaatttgaaagaaataaaacttagaagtatttgaggaagggacaaggctcaggaagatgcctatctccctgaagaattccagagaaattagaggcatggaaataccagatacaaagaaggggaagagtgaaacatggaaatgaagagtcaagtctgtcatccaactgacggaagtttcagaaagagagtatagaaatagcacgtgagagaaaagtgtcagaaattataagatactttatctgagctaaataatacaagtcatcatacggatagagtccacagagtagccatcacattgaaaataatttcttatgtctagacatattattacaaaatttcagaacatcgaggttcaagtaaatttgcaacagcttccagaaaggaaatattaaagcaaaacaaaacaaatcaagacacagctaacccataaagtagcaagaatcaaacttgtttcagcaacactggaaactagaagtctatggaccaagccctatggaccagggaccacatctgagagagaaaaaggatatgccatctgtttatgtacatatgtccatgggaagtttcatagaaactcagagttctgctggaaatgatattcaacctagaagtctttttttttttttttttttttttttagatggagtctcgcccttttgcccaggctggagtgcaatgtgcaatctcggctcactgcaacctccacttcccaggttcaaacgattctcctgcctcagcctcccgagtagctgggattacaggtgcccgccatcatgcccagctaatttttgtgtttttagtagagacgggtttcaccatgttggtcaggctggtctcaaactcctgacctcatgatctgcccaccttggcctcccggagtgctgagattacaggtgtgagccaccgtgcccagcctcaacctagaatactatacttggctagcttagcctaggcactctgctaaaaagcaaagttccaggcagggattaaaatacttatattttgcttgggaggtataagcctaaggtggtgagcatgagaaacccagtaagtgaggcatgggaagatgtgaagcatcaccgcacagccaccaattcacaatgagccccaaagaaccatactcagcatgtgtgtgtgctcagtacaagggtgtacccttcctatctgtttttcattggtcaagattaactccatgatacaatacacactctcaccccccacccatatacatttctaggttacatcatccagcctcagtgacaggtcaggaactagaccttacactttgcattgggacattacatccaaatcgggaagaagaggggcaaccccacacagatggggctctgaccatagagggaaagaaggtacactaaaattaaccttacctaaaattgcatcattcttgagaagtcattgaggttgtatttctgaaaaccaaggaagtaatctaaaatgaatgaagaaataagacctaaaaagcaatggctttaccccaggagagcaaagaatgttctatgattatggctggacagttggctctgagaacaactatttcagacagaagcaggggacaatgctccaacaagatctacaggaacagcttgagcatatggtgaaagcatttggtgggagttttaaaaaagaatctattcaaacatcactctagaaatattccctttgagtggtatagtcatgatattaaattcgtagagaaagaaaaatactcctagcacaccactcaggtcaatgttgaaaagatgtctttcataataatgtaaatgtgtattgattttctaattttaaaattaattaacagacaaattacagaagacttagactattacaaaatagaatgtaaagttatcaaccatgacaatataaaagcacaatggaatgggtggaatattgaccacacctgagggagaaaaaggatatgtcatctgtttatgtagatatgacaacaggaagtttcatagaaataatttcacatgcccagatgtgtcacagaagtagctgaaagacactggatctgatagggaaaatggacagattacactatgtccaagggccccacccaaccctgttgacttatataagattctggaaccattactcaaattccatgggtgacagtaagtctataatcctaaaaagactgggattagttttcctgctacatgatagaaggtgcttaaaagagaattacactttgttagagaaaaatagagtcatacatcgtgcacacctcagtttggagacagctttacaactactctagatgtgtgcagttatttaatgtaacattgaaaacattctaattgttcatcaataagaatttctagtacaatgtatgttcactgcagcaccgtttacaatagcaaagacttggaaccaacccaaatgcccatcaatgacagactggataaagaaaatgtggcacatatgcaccatggaatactctgcagtcataaaaaaaaatgagttcatgtcctttgcagggacatggatgaacctggaagccatcattctcagcaaactaacacaggaacagaaaaccaaacaccgcatgttctcactcgtaagtaggagttgaacaatgagaacacatgggcacagggaagggaacatcacacaccggggcctgtcaaggggaggaagagcattaagacaaatacctaatgcatgcggggcttaatacctagatgacaagttgataggtgcagcaaaccaccatagcacatgtatacctacgtaacaaacctgcactttctgcacatgtatcccagaatttaaagtaaaattttaaaaaaagaagttatagtgtatccacacactggaacacatgttaaatagtcatatagttagatctatatgtgtgactctattcatgttacaaaacaacactctacgtttatgtgtgtgtgcatgcatgggggaatgggggcatacatgcacacgcatgtgtttgggtgcatatcaaaggtctggaaagacacacatcaaagtattaatatgataatctggggaaataagaggaatttgcgttatgtgaaagggaatttttatttttactttatattatgtatgctttgttgtttctgaggatattttaattcagattatgcatgatctgatttgtgcacatatattgtttataagatgttagcctcttctaaattttgataagaaattcatttccaggccactcatgtcatccctgtttcaaaaacccttgaaggcttcctgctgcttcaagaaagagacttaactccttaatgtggcttaaaagagatttcatgatttggcttgtgtttactccttttgctttacttcttcatttcttgatagtatacctactgtcaagggggcaatctcaaagctcttccaacctgtcacagcattatgtgcaaagtccataaactttagttgatactgagacgtttccatcatttctactgtcaagccagtcaattctcagttaacagcaaacaacagactactagcattatgttttccatctttccctccaaatctacacattcaataggcacatgattttcttcccaagtgactataggcaacatttataacaaatgctttgcctctgcttaacagggatcttcatcttttcagtcttcaatatgtttccttaacacccaccaacctaccactctgtcaaagtcactcattttagattttgttatagtatgccctagccactgtatcaatttctgttttacttagtcagcacctggttctgctgaagtaacaacccccaaaatctcaatggcttaaagcaactagagcttatttattgctacattatgtgatcattgcatgttgactggggccaacatttttctttcttatggacccaagctaagatggactctatcttcttgcttctacaatgtgcctggaactttacatacttcatcttgtttaatcttcacaacaattattatctgtgctttctaggagagaaaactgagtcatggagatattaagcaattttcccaatgtcatgcatctaagaaacaaatcagttaggacttgaatctggacaacgtgtttccccctaagcttaccctataccttcgtaagatatttatgaagagtcatggtaaatgaatggagataataaaattgactgggatgggaagaaggggtaggggtttatctcaaaaactgatcttggaagagaatgataatttcaaacttaaattttaattagtgacagtatataaaagcaaaattatgttatgatgttaaacaaacagctaaaaattgggtgagaataacatgtctctattttagtaattccatttactcagcaaaatgcttatggcacgattctttaatttagtgcagtacagcttgtatgtctagggccactgtgagtcctggagtgcctgggattatctgcgtagattggacatgaaggtttaatggccatgaaacaggcagtattgcttgacgccctaggatttgtatgggagagctgaggtagacgctcaacccccggcagcattctaggtggaaaagaaccactataaaaggaaaaagctggggtcctctcacagactttgctccggaagctgaacagagtgtggtggagaggagctttttgaatgcagcactgagtagtgtgtccctttgtcccctgatgcaggatgagagttcaggtgtctgttaactagttgagctccaggaaactgggaactgagaacagactatagaggaccatcatgttttgaggtcatgtggaattgtctctaacacttgaggaccatttcccaatccagcaagtatctgacatggcagaaaagcacagcaatgtcagtgagtctgtgaggcaagtaacacctgtagcgacagctacagccagaagggatgccatccacctcattagtgtaggacacagatgatcactctctcctccttgcaaaactttcttcacctggctttcaggaccacacacacactattctagttttcttttttacctcactgcctgtccccaagtctttcttgtcccggtaaatagaaactccatttgcttaggccaaatatttagcctacccctgactcttctttctcatacttaccacatacaattcattattaaatcctgtcaactttcccttcaagccatttccagaatatgatcccttctcccacacttcttactatagccacagtgaccatgtcaatcctctgctcaaaactgtcagagctgcatcatctcacagatatggtcctacaagatcagatttcttgtcacctatttgatcttatttcccatcattctctccatttctcactgagctccagctacactggccaccttgctgcccctcacacatactgaaactagtgccaccttaagatctttacatttgtgcccctccccaacttcctggaatatgtggcttgctctctcacctccttcaggtcacagctgaaatgccatctttattagagaaatatgctctgacagtaccatctaaaatagcagccctgccaccatcccctccttgaataactcccaatctccctctcctatttcttattattacctctctatagcacttattgccatctgaacatatttgtttattgtctgccttttcactagaatgtaagctgtaggacagaaaagttttatttgtttcctgagagcctgggcttgttttggcacacagtgaatacaaagtaaatatttactgcatgaattactgacctaaccccatgttgcgtttgtagaaagagaccagcaaaggagaatgagtcttgggaagttaggctaaaagaggccttggaaaggccactgaggaatccaaatgagacacagctgagagaccttaaaaaaacagaaggaattggaattccagtgatttctctgaaaaagagttgctacaaaccagagactgctgctgtttttcaggggcctaggaaatgtggttccagcatgatgagtttaaagtttgacatattttaatcagcttagcaaaggcattcgttttatagaaaaagctggatatatgtgactatatatcttgggtagggggtcaaaatgagcagagagccatcattttgaatcttagggagagcacaaacttcgaggcttacattcacaatacaatcaatggcatccttctgtcccctggtggccacacagctaaactgcatgaagagataaagtctttgaagataaaacaaaacaataatttcaaggtaatatctttcaaagcctgtaccaaccatacatgtgtgtgcagtgcatgtgtgtgtgtgtgtgttttagcataaagatctcccaaggtttctttttcatgaaacatgtccgtgctgccttactctgagttcagcattaaaggggaccagttgaatggaagacattaccctgacagctaccttttgctgtaaaacacaccccccagtccagaccacaaacaagctcctttcatagccatctgccaggtgtgtttgtagaactgatatctgttgaagcttggaggtttgtataggcaaccttaaagtctgggattctacaactttatgatgattctttctcattctatccccttccagtctatgagtctgggcatcccaaattttcccacttcaggctttcacttgttggaagcatctacatcatctttggattcacttctatttgtcccattttagttctgcaaaaccttacaacaagtattcttgaagaaaaaataccagaatagatcctgcacagatgaaaagaattaatttagcattgtatatctgttacatgcaagcttgtatagatttaggtatgtgtaacagatatctaaatgtctgttcaattcttggtttggagttgctagtccatgatattaaaggtgaaaaaggtcctgttcattttatagatgaattaagtgcagtgaaatgcttacttcaagatcacatagccaattggaggtagagccaggactagaatgcaggccttcttacaccttaccaaatgctgctgttggcagcaaagagacaaagctatcagcatcgacgaagctgaccccagtgaacagtgctccctgtggttttagatagttcaacaaacctcgttcagctcagcaaacaagaaactaaacttcatgacatccttagttttgctctgtgcctggctgcctagacctaccaatcatgatttccaggggattccaactccatgatatctcttacattcatcaattttcttccaacttccacagaaattgctgtggttcagacgagtcatctagaagaaaccctgttgcaagttctatacagcacacatgtgccaacacacacacacagagacacacacacacacatgcttgcatgtacacaaacacacacacacacacacacacacactacccataagtatatgtaaagagaacggcgggtattatatcccaagcatgccaaaaacagtaggcccagtgtgtatgactgttgtgcttttttggggggtaagctgtgattcacaatgaattccattttagaatgataattttaagggctggcacaggatctctttagctatatatgtatacattgtatatctgtacatgagagagccacttgctatttttaagaatattgttttctcgcttcttaaaacaaagtattatttttaaattacagaagaaacactatttattaagatttgaaaggtatacatcctataacccagtaatctcacttctaaagtggatacatggacccaaggaagtttgtacaaagatattcatagcagcattgttttgtaagagtggaacagtagaaactacctaaatgttcatcaataggaaaatgaataaactgtgtcctatccatactgtagatacagtatggcagctaaactcaacaaggtgagtctgtatatactgacatgaaaaaaaatccccaaggcatactgttccataaaaagagcagtctgcagaatcatatatattatttacaataaaaaatacattcatttattcatgtaaatgtgcagaaaagcctggaatcttatacatcaaaatgacagtatattttacctcatgggagtacatgggaaggtgggggacaaagagaagacaagatgaagggcaaggggcattttaggcttttgttatatcatgatgttttggctgaaaaacaatatcatgtattgtgtaatttaaattaagtactaaaaattaatatgtaattgtttaactatttcaaatcatataatacataaaataaaaagtgatatttcatctttacttttccataatttatttatcccttccccttttggtggacactttaaagttgttttcattttttaaatttgttattacaaagaaaattcttctttgctttttttctttttctcactcatgttattatttctgtagtatagatctctaatactctggtcatggaacataagcacttaaaaatttgacagatgctgccaaattgccctctagaaagactacgctaatgattcatagaacattagttctgtccatgtaaactccctagtttacattaccaagcttgctacaatagcagttgcacccagacgttctgatggggcctcaagtccagatgatagctggcttcatttccttccctttgtcggttgaccattggtggaaaaagtgcaatgtctgaccagatggcccaatcaatagagggagctggggtagagtgagaggggctactagaagactaaatctgcaggagctatgaaacgccgacaaattaatgacccatgggctacatgtgacccacagacatgtttcttttggcctgtataatgttgggctacagagtgtgtaaaaaaatatgactcagtggtaagcattaaaggaacagtgcttaatccccaacttgtgatgttttctttcaggtcgttctctatgtacagatttatcaattcatataaaacccctgatatttctttatttcctcactccttccatgagaggtaaaatggctcctttttccctttttctttgtagctggttcaccagcagagcacgtttctgccttcaactgggcaataattcaaattctggagtttaacattagaaagactagctgccctgagataagttccattctggaacagaaaggtaatatttttatttgaagctatctttatctttgtctcccaattgattcagaattaaactaggaaagagatgtactattgattggacctccttaaacccaaacaccatgttctaaaatatggaaattttgaaattgagagattgtgcatcataattgatatttctggattttttgaaaaaactggaagattaaccctgagcccttgtttctaaattgtgtgctatccaacttatcacagtccttactattccctattatctgatacctagaatgagagaccactgacattgagcctcatgtgataataaaattgtagtagacagagtaatacaccccccaccatcacaaagatgtccacattctaatcctcagaacctgtcaatatgttcatggcaaaagggattttgcaggtgtgattaagtatagggacaatatctggggtgggcccaatataatcacgaggttcctaataagggaaatatgaaaacaagaggctcagagtcagaaatgatggaagcagaggtcagaaaggaacgggatttgaagatactacactgctacctttgagggtgctagaaggaatcactagccaaggaatttaagtagcctctagaaagtagaaaaggcaagaaaaaggattctctcctagaagctccagaaaggacacatctctgcttataccttgattttagatcagtaagaccattttgaacttctggcttccagaactgtaagtgaataaatttgtgttgttttagaccaccaagtttaagtggcaatcggaaaccaatacaaaagttaaggagaaagtcaaacacttcttatactggtacacctatcacgagagggaaaacaaattagatcaagatggctatacatttcagtaataatgtgagagagtatttctttgttttgttttgtttttaagagacagtgtgtcactctgtcacccaggttgcagtgcagtagtgtcattcactctaacttcaaactcctgactcaagaaatcctactgcttcagcctacctagtagttaggactacaggtgcacaccaccacagccagctaacttttaaaatttttgtagaaaccgtgtctcactatgttgcctagactggtcttgagctcctggccccaagtgatcctcaagtctcagcctcccaaagggctgggattacaggcatgagctaccactcccagcctacattgctgatagtttagccagcatccaacactccccttacctttcattaaaagtactctgatttttgtttaagtatttaatgctctcccatatctttgatatactttagggaaaactaatgcttctctggtctaaatgtgattctatccttgctacaatgaatcattcaggagcccaaatttaagaaagtcaatgaatagaatttccagattaagagattggctcaatattgggtatgtggcttaattttgtttttttttcttcctgtattctttctagctagtgacctaatttttaccagtgcaagtctgtgaaattgtttcctgtttctgtattacaaacaacctcaaaacgtaatggattggcagaagtcaattggaagattcttttgctccacatggtgtaacagagttactaatgtgcctgcatttagctaggagtttggcaggaggtagaaattccaaaggtggctttttattctttggagtccatcttcagatgacttctcttcattcagtagtctaacctgagcttctttacggtatggttaacagattccaaggaggagcattccaagagacaaggatgcaagaacacaaagagaaaaatacaatgtgtaaataaacttttgctttttcatcatatgtctcattggccaaagcaagtcatatgtccaagttcagagtcaatgaagaaagtgactacacaagggcatgaataccaggagaagagatttattgcaggccactatccaccacaggaatgcttagcagaggtttaagggaaagaaattttcttatttttaactattcaaatatattttctttcttcctctattcaatatggtatacgaatgggaagcctggatctgctttagccatttttgcacaatgatgaaaatcaggctaaggataaagtcaactaacagagtaggctaggctaaggataaagtcaacaaacagtgggacacaaatgaagcaatcacagagaaacagaccttaggccacaggattaagtcaacctgaaatatgttttatttctggacttccaaataagttaattaaaagcattctaactatacagcaagtgaattccattactgcatatttaacatgcaaaagatgtctgttgacagagtataacttaaagtgccattatgaaacaaatcataagaactatgatagaaacatggaagtgtttaataataaaaataataaactaaaaaaaaagaactgaaatgtcaacagtgtttgctttggaaagcaaattggtgatgctattaggaagtacagttatttataaagtaaaaaaaaaaaaattgcttgtgcaggaagcccttttagatacagcatatatagagtttgaggtggagtcagaaggccatttagaagcctccatctggccaggcctgatgactcacacctgtaatcccagcactttgggggactgagtggggcagatcacttgaggtcaggagttagagaccagcctggccaacgtggtgaaacactgtctctactaaaaatacaaaaaatagcccagcgtggtggtgcgtgcctgtaatccccactactcaggaggctgaggcaggagaattattgcttgaacctaggaggcagaggttgcagtgagctgagatcgtgccactgtactccagcctgggcaacagagcgagactccatctcaaataataataataataataataataatagtaataatggtggccaggtgtggtggctcacgcctgtaatcccagcactttaggaggccaaggcaggcggatcacctgaggtcagaagttcaagaccagcctggccaacatggtgaaaccttgtctctactaaaaatacaaaaattagcagggcatggtggcaggtgcctataatcacagctacttgggaggctgaggccaaacaccgcatgttctcactcataagtgggagttgaacaatgagaacatatgggcacagggaggggaacatcacacaccggggcctgtcgggaggtagagggatagggtagggatagcattaggagaaatacctaatgtagatgacgggttgatgggtgcagcaaaccacaatggcacatgtatacctatgtaacaaacctgcacattctgcacatgtatcccagaacttaaagtataataaaaaataaaataaatttttaaaaaaatctctggacacatgtttctcttctgacattataggctctgaagtaagaaccacagtcgtcatacaaacctggggagtgttgcgcaggcatttccttcctactcacggctgtgccgtcagtgcattattaatcaaagcttgttcaatcaacactctctcctgccaacctgttcaacacaatctgacatttgctaaatgtgcttcaaagaaaaaagaaggaaaacacatggcaaaatatatgaaaaatatttaacttcactagtaacagtagtaatcagagaaatgcaactatagcaagatacctatcaaattggcaacaatgaaaaagtatagcaataccattttggtaaatatatggagaaatagtaccttctagagggaatgtaaaatgatgcaacaacttcagagggtactttggcattacactgcatttaataaagaatgagatagctatagatgttgatttagcaatatctagctacgtactctagagaaatccatatatgtgcacaagaagacttgtccaaaaatgactagtgcagcatggtcaatagtaataagcaacataaatgtccctctgcaggagaatggatgaatggatgcactggaatattatacctcagttaaaatgaatgacatagagtatatgtatcaacatgactaaatctttaaattacaatgtgcagtaagaaaaacaagttgcagaataatatacaatgcatagtaatacataaaaataatactctttttatgaagtatggcaacataccaaacaataccatacattttttcttggtacctacaaaattgtaatagtaaaaaaacatgcaaaggaatgctaagcatcacattgatggcagtgaacacctctggaaaagagcagctagaaatgaaaattggggcatgaagagatcttcatccggatctgtaatgtttatcttatattttagaaagagaaattaataaaaataaatagggcaaaatgttaacgtttggtgaaactggctggaggattgtttttaaaaaagaacaaaacaaaacctcgaggagtaatctggcctagaaactccttctaggattgacagtgataaattgatccacgttcctcaaatggtggatagttgaaaactgaatttgaaaacgtgctttctgattattttagatacatcatactctatcaccaatgatagagtgaataaagagcaacagataaaatccatgaaatgcagtgttgaaaattaaagatgatgacagcaagcaatcagaatgctagaaatgcctcagaagaagttatcctgggccatttcgcaaatttttattcatgtttggaagtaactacatttgtgaacagctgtttcttcaggacaaaactaagaactgaatagaactatgtaatgctcccagttaaagaaatctaggctaaattctttactgcacatcacaaagagaaataaaagaccttgacattgacatcttgggcctgaagaaaaatgttgttagactcacatgaaaggattagaacattacaaaagcaaaactaaaattttcctgtttctattggtttttaaatttcaaatttaaaacataatttccagtgttgtacaaattattaatactgacatcaaagcttaaaaaataaagctcaattctattcacagcagctgatttttctaataccgtatatgttacctacctgctctctgatggcacacccttccccctgcaatatggcttggctgttctggcatctcactttatctttcattatgtctctacccagggttgtatcaaggagggtagtcagaatggtcctccctgggtataagcaataagagggtgcattgtcctttaaatttaaaggaaatttaaagacaataataaaactaaccaaaagttgatctgcttttaaaatgttttttgtatgaaattatctttatctcaccttcatttttaattgaaatctgtattgataaatagactttatgaaattgtaagaaataatagggagagatcctatgtattcgtttcccagttcctccagtggttaacattttgcaaaactggagcacaatgtcacagccaggatattggcattgataagatttgattttagtcagatttcccagttttacttgtactcatttgtgtgtgtatttagttctacacaattttatgacatctaggtttgtgtatccaccaccacagccaagatactgaacaggtccagcaaaaggattccttgtgttgcccttttataaccataccgaattctctcctgcctcctgatggaggaggttcctctcccttcaccatctctgtcctctgacttccactaatctgttctccattttttaactattgtttaaaaatttttatatagattaaatcatacagtatgcattcttctgagattggcttttttttttttttttgagacaagttctcactctatctttcagactagagtgcagtgtcatgatcacagctcactgcagcctggacctcctggtctcaggcgatcctcctgcctcagccttcgaagtaggtgaggcacaggttcacaccaccacactggccacttttttaatttatttttttggtagagatggggttctgcttatgatgcgcaggctggtctcaaactcctgggttcaagtgatcctcctgccttggcctcccaaagtgctggaattacaggcctgagttgctgcacccagctgagattggcttttctacttagtataattccccagagatttatgctattttttttttttttttttttttgcacgtatcagtaggtttttgtttttgttttgtaatattctatgtatgtaccacagtttgttaagccattcacccaatgaaggatatctgagtggtttctagattattgctattacttataaagctgttatgaacactcatgtctaggttactgatctgattttttatcacctggaaattctgtcatttactggagtagactattcccatcaacctgtttcctgcctagtacatcatgctctctgccacaattgctgctgataccattatcagtactgctgctggtgttagtagtattgaagcttggacagtcttccctggattggagagtggtagagagacgagagggcatctgtagccgcagctctgacattaagaaaacgtgggctaatccttaaccagacccaagtgtttctgcttctctcttcatctgccctcttctccgcctgttaactaatactctgcttattttctaatccaaaattcagagggaactagtttgcttggcttagctaatgtgccagccgccttatgggcttaaaatccgtctatggatgaatcatcactgggtcaggtgctcatgcctaatgcaatatgtactcactcctaaatacagcatctatttccccaagctgaagggcaggattatttgatctgtgggctatgcaatttctgctaacaggaggtattgagtaggccatgactgcaatgtccagcaagcatggaaaattctctaggtaaactagaagcccatcttaatcataaagtaagccaaaaataataaaacacccacaaagtgttgaatttttataataatgttcttcaaaaaatatggttgtaaaataaaccccaagataagaagataaaaaataatctgtaatccagtgaaaagttaggtgatgcgcatcagaaaggaataatctagttttggaaaaactgatttatagcccttctttcttataataaagagatcacaagtttggtttactgataaggttcctctgagtccaacatgataaaatcataataggtaaatgtgttttgtgttcgattgtttataacaattaaaacaaaggcccaaatcattaaggtataatttttaaagtgaccacacaatatatcttactctaatgtaggggttggtaaactctaaccagcctgctacctatttttatatgtaaagttttattggaatacagtcatacccatccatttacttgtcgacagctgcttttacactacagtgacatacttgagtagttgcaaaagcaaagcctcgaatatttactagctggccctttacaaaagaagtttgctttgtttaattaccaataacccattataccaatcctgatcatttttggtggtattctgtatgagcattagctgcaaaagcccatgttaattcatgcaacttaacccatatcaaattcctagcctacaaaattagaggttatagaagggtcagtacatgccacaatctaatcattttcaaagagattttctccataaggccttataagaaataaaaataaattgacagaattttcattaaataatacttcctcatataaaactctgccctgagaaatctagattgaaatatctcaagttaaagctggttgttatggtctaaatgtttgtggctcacccaaagtcatgtcgaaacctaaataccaatgtgatggtgttgggaggtggggcctttggtaggtgattaagttatgagtatggaaccctcatgattgggattagtgcccttacaagagagactccagagagctgccttgctccttccaccttgtgaggacacagctagaagctgtcgtctatgaaggggaagcaggctctcaatagacactgaatctgtcagtgccttgatcttggacttctcaacctccagaactgtgagaaataaattcctattgtttataagccacccagtttatggtattttgttatagaagcccaaacagactaagacaatggcattcatgaaaaatgtatctaaaatgataaagcattcaataaaattaaaaggtatgcatttgccataaagttgaatatttattactagataagcccaggcatcaaattccctgacctagttgggggtagctgtgaaggaactttctgatatggttctcatcttttaaggatcccagaataggggtggttgcccacattttgtctcccatagggtcaatatatatcatactagcagtcctgcaagtgtctgtacaggatactagctttaatcttgagctcctcagaagacatttggggaaaggatattcttcatgaagcaataggggccatttctatctagacctgaattgtcaatacatcatatatatccaagaatgctgtggaatgatattcagtgggaccacagggagaattacagtttgcaactagacaaagtgggctagagtctcctaaactactgatgttaaggcatattgatgatagtcatctaaatcttgtaagagatgaatgtttgagatcttttcggccgggcagggtggctcgcgcttgtaatcccagcattttgagaggccgaggtgggtggatcacttgaggtcaggagttcgagaccatcctggccaacatggcaaaaccccatctctactaaaaatataaaaattagccaggcgttatggcgtgtgcctgtagttccaggtactcgggaggctgaggcagaagaatcacttgaacctgggaggcagaggttgcagtgagccgaaattgcatcactgcactccagcctgggcgacagagcaagactccacctacaaaaataaaaaaataaaaaaatttcataaatatacaaaggttaactttagagaattacttgacattaaatcctctttaaccacaaatatagctccaccttctaggttataaaacaaatgccccttgggtagattctagcacatgaggtgaaatttatttacctcttaatcttttttttttttttttttttttttgagatggagtctggctctgtcacccaggctggagtgcagtggcacgatcttggcccactgcaacctccacctccagtttcaagcgattctcctgcctccgcctgccgagtagcttggactacaggcatgcacgaccacgccaaggtaatttttgtatttttagtagagacagggttttgccatgtaggccaagctggtctcaaacttctggcctcaggtgatccatccacctcagtctcccaaagtgctgggattataggcatgagccaccatgcccggccttaatctttgctttggtatctgctgtaagaatgacttctgccacaaaaagtcacacactttttctcccactttttaaaaaaactgttatcaaaaataggcaactatttttacttaaactttgaaaatataatcctggacgtcttaagattaaagaatgtgatgatgaaagcaggtaacactcaacttggaaagaagagcagaaaagtactttcactagagaaatcgtaatgagaggttgccatcatttaggcagcatgtgggtactttacaaacataaaattagagcgttacaaaaatcctttgaattccctaattttacaaacttaaagtccttaattaaaaacaacaacacaattgcaagttgacaaataagacaaaatcccttgcaaaaaataatcattaaaaactagtagttacagaatatatttttacactgatttttgaaaatgaaattttgtgttaaaatcataaaataaaaagcataaaatagaagctattaattatgttgtaatggtaaatactggatttgggctgctattttaatggtatttattctgcataatatgcataatatatctatgtggtcccatattcatttatcctatttagaattgctttcttttttctttttttttttttttgagacggcatcttgttttgttgcccaggttggagtgcagtggcacgatctcggctcactgcgatctccgcctcccgggttcaagcaattctcctgcctcagcctcctgagtagctgggattagagatgtgtgccaccacgcctggctaatttttgtatttttaagagagatgcggtctcaccgtgttggccaagcttgtctcaaactcctgacctcaaatgatccacctgcctcccaaagtgctgggattacacaggtgtgagccaccacccccagcatttcttctatttagaatttctaagagcaagcagaatgtcatttctctaactattaaatgattatccagaagcaaaagtacagcacaggaagataatatttattatattttaactagaaacagagcagatagcaagttcaccaggtaaaaattttttttcttaaattatgcttaaacaacaataataaaaaacaagtctgcatgtatattttggtcactattatgatcttccagggcacaaaagccagcagcataaagaaacatgaataatgactgagaatttttgatgtgccaaaaacaaagatcactgcattaaactcctttattttgttaatattattcttaaacattgaacaattattaattattgttatttggcaaaatatcaaacatgcacatagtattcctacaagaatattgccttaatattgtcaatattaacgctaagcttattcctctccaaaattcaatgagttatggttccgctctctatatgtattagtgttagtggtaatatgcaaaactgattttgttttcagggttaagtagcagattgacttcgcatttggtggccagctgtgtaccctaatttttcatctattttcttaataaatttaattacatttcataagccctgagataacgtgctaaggattgtatacttttaatctatactttattccactcaatttgaaccccacataataagtcttttaagttatttacagatggttgtaactaaagcaatgacaaaatttactacttgtataggtaagactgataataaggcctttaactaagagttgcatattttatatgcacttttaacttgctaggagcaactcttaaaattacatctataattctgtcagaaagcaataagtgcttttcattttgcttacttccatatgtgtaaccagattcacttttttcctcccttgtaaaacaactactttcttttccttccccaaatattaatacgtcttccaactgaacaattgctaaaaggaacttagcatttgcacagcacattgacaactatggtgcttagcagagacatatgcccataataggcatctgataaatgtttgttccacatggaatgagtgaattgtaaggcagctgtttgagtcatacactgttcatcatatactgcaactaattttatttaactaggaaattcagtttaccagatttaatttaccctcaagtgtaaatccaaaaatttgaaattaaaaaaaattgatttactaatcctcagaaaaagtaaacaagttaatcatagttgttactatactattagttgatagaaaattaaaaaaattattactttccactaaatattaagtacaactgaggggaagaaagtttaaaaaaacttaaaaatgttagctaattctcatcattttctccacatttatccttgcagcttttttgttcatatatttattcctgttaacttctctagctgaaagagaattttattatctgaatggagttccccatcaccttaggtacaaaatattagtgaaaagctggtgtaaatataagattgtattttcatgtcatgccatatttctaaatttattttttgctagcattaaatttttcctatttaaacgatgctgtatagaatatgagctaatctgccaattactatgatattgcttgcttataatattcagtttttgttgatagctttaaagcatattgcacgcttttcatctagcacactagtaaacaactattactctttttggaaaggatacactgacaaattcttaagttaatggctttagcccaacatttttagtcagttaaagaacaatagcaatggcaaaaacgttgacaatacagttcatggtccggttctcccatcttacggtacaggttcctgaaacacaaaaaaaggattttgaaataccagcaaaacataaaaattatcagagaatatatatatatatatacacacacacacacacacacacacatatacacacacacacacacacacacacacacacacacacacatatatatatatatatatacacatacatttttcacatgttttaatatcttatttccttcaacctgttaagttttcacatttcatatcggtctgaaggtatacttgttactaggtacaaagcaatactgttgatagtcttttcagaatttaatcagaattaaataagtacttggttaaaaagtgcagtttgactttgctaaaagttggattttgtgtaaatcagcttaagatctcttaccatcagatgtggtatcccaaaaacaggagctggctgtgtgaaagccatatgcgctcttctggaccactgcacaggtcactgcaaataaagtcacagaatgagggcacttacagacaaaggaaaagagaaccaaggtcaaagtgtgtgagttcagagctctacaagccgaaaacaagacaaaaaacaaacaaacaaacaaaaaacagaaaacaaagcgttcagcaaatagattgaaaaaaaaataaaagactctcatctttatctaccatcatgattttgaccccactggattcagttggttttctgaccattgtcattaccattggtgattgtattgcaggaaaaatatcagtcaaattctgtgctttgtaccatgggcagaattcagacacagaaatgcaggaaatactccactttataaacagttgctgtgtggaattacaggtaaagaggcatgggactaccgaaagaaacacagttgagctaagggggggtctcagtggaaagaaagaactgatggaaatgcaaagggtgatgctaccaaagaaaagtagctcaaactgcctttgagtagtgaaagatcttcatcttttaagtattattatagattatctttgaatgagtaaatcagaagtcctttatacccttttagtatccaacttaaatgtctattgtacatataccttctcaaaattcagagaaaatcacaatgacaaaagcaagtgaactagtgaggaaggatactgatacttaccaatatatttataggcttttcccaacttaaccaggtgtgttaaggattgttccactatgcttgcagtccactggttgatgttgttgtgattataatcttcaccacctaaaaccccatctacacactaaaagggcacagagggcagttaatttagtcagtaaaattgttcaaaaagaacaatttttacacaaattgcagtaaaaatttattcaaaacataaaatatacttatagctcaataaggcatcttagaaaatatacacttggtaaacattgattatgcactgtctctaattgcttaagagttttgaaagagtttccacttgcattatctcactctatgagatactatgggccatataaagataaatatgtcatggcttctgtgtaaataacttaatctagcagagaagctaataaaaaaattcgaatatctataacacaaggaagactaatgataaattatgtcataaaaattatggtggggaaattaaaaggtgctatcaattggttaacaagtagctttgaaacagctgggatttgaactagggctcacatgctagaaacaggatgggactaatttaaaaacataattcttatgtatactaattatattctcattcatactatgtgattgtttagctatgaaacaacaactgattatattctcattcatactatgtgattgtttagctatgaaacaactagcacacttgccactgaaagtaaataaagatgctctagaaagataaagtcaaatatcataatttcccatagtgcttgatttcatccacttctgacacctgattaaaagcactggctctagtatcacaatcctaggttttaaggcctactttgacacctatctgctatgtgacctttagcaagtgacttaaccccttcaaatccctattttcctaatccttatagtaaggataacagcatcatcttatcaggttgttgttaggatgaaatgagacaatgaataccaagtgctcaaacaggactagcacagagttagcatataaataatgttaactactattatcatattgctgctgttatattttatatttgagtgataaagcctggataataaagcactcatttaattcatttttagaatctaacacacacatgcagcttcatttactatcattagactcatttaattcatttttagaatctagcttaataatacacacatacacacacatgcagctttatttactataattagaccacagtaaagatttatgaaggcactaatacaaaatcttaagttggatagtataaaatcttcactaatgataaaatatgaaaagagaaatgaaatattttagcaaggttgacaaaagtaatatggctcaaatttttctcctagaaagctcaataacatgacaaagtaggaagggtagtggcttaaggatcaggggaatagaattttaattctggctttaccattcctaagctggtgacctttggacaaacctattcctctcttgagatcacctttccttaaggataaagtaagagcactcatttttctttcaggttatttagtaggaccactccaagttttgctctaaacagcagaaaacaccatggggtgtgggtgccactgtaaatagccctgctaattactattaattaacatctagcctaattaattacattaacatggaggcccatgagacaatgaggtccttaaacagctctgtattctcagtgctaaactcaggacctgggcacttagcaggtattcaacaaatgttgttgaagcaatattggttttgatatactcgctgggtatcttaaatcaaatacactttagactaaattctaagtcatttgtagctcactttttcttcgacgattttttggggaagcaatttctattactaacactaaagaaaatgtatgcatattactgataaatgggtgtctctgagttcagaaggaaaaacatattagcataggggctcagagcaagaaatcaaaggaaagaaaataagatcaataagaaaataagatcagtaaggaaatcagaaataactgctgaaattatgtaatcatctaggaagtgctaaactgttttaaaatgttgctcattctcaggcatttccaatgtctcaatggaaatgtttcaatggcagaagagggttggttcatgggaagaggaaagatagacatttagctgcaagtaacctgtagcaaagctgagtttctttgcagtctcatatttcatataaaaattcaagagaagcttgttttgactacataatgcatcagagtttgtttttattcaaaaatgttttcagttatattatttatattacttaactccctctcacaaatattcaagaaaaactgatgttctaaaatgcatccagtgacttctagcaccacctagccactgccgagtatgtatttcccagttgaaaaagcatgattcttttaatttgatataatattaaagtaacaggcatatggtttgaaaaatccagtagaacagaaaagcttagaatgaagagtttccttcccaccctttcctttcccatccccagtcccattccccagaggaaactcatcagtgtacaactgtttttatttcttccaagggttacttatgtatctccaaataatgtttatctcactatttcctgatttatgaattataggcaacatccatgtaactcctactatgatagatgaaaatttggttccctcagaccacccgcccccttctctcaatatagtgaaatcacgattttttaacttaaatatatttacactgttagaaacatgtttcttttccactctggatgttttcttcaacgcagaggattgttctttaacattcctggcctcttgtcctgtcagttattcctccccatggaggtggaatgagttacctggttggtgggtgataaccattgttctaacatctcatttgggagtctcccaaatgtgttgaacttgggctttagtttctccttccctctccacccaaaccaatgaaaggcaccagcctgaacaagtgtttctctctgctgactcaaactttctcttggatgactcttcccagggctgaactgaatgggagttagcaaaacaaggtacaatcatcaaactggtttttatcaataataaaggtggtattttgttctctttctaatggctcttttttcttttcatttggttcagaacttaaggaagaaggcactatttaaatggaatcccaaatagcccagcattctttcttttatgttccatcaaccaaggacagtctttcctgacttgccactttgaaaactaagatcactcccttctcattacctccactccctcttccacctcccagtttccctcatttgtgcttttacattgtaaaggtattaaaaacctttgctttctacttttaataattaaatactctcaggctacatagatagaatgcataattctgaagtattcaaatatggcaggattttcaggtgcctgtctattcctctcagaccttgagttaattctagctgtgtaaggccagacctgggtgtcaaaaaatacctttcccacactgtggtctgtatgtgatacctctaaaataatgaacggtcccctgccagaattaattcccaaaggtaatttcttttctatttgcctaaaaggagtttcaaatatttttcttaaaattttgattcactatcatatcaatgcttaaaatatgttaaatgatcattttttccaattatattgggcaaaaaagtgtacatgcccaaaggcagatatttctagggcttttgttatctattttatacaatatacatatatattatacatatactttacattataaaagttgacgtgtgtacatatatatgcgtacatatactttatagcattaacatttaaaataatgtttgctttctggaataaaagttattttatccaaaagacagggcatcaattttaaaccagttttctagactaagaaaatccttaagcatctctttcagaataagcctcaagatgctgatagcacacaacaaaatatagaaggacccctataaagagttagtggataaatatttaaaatcttgttcttggccgggtgtggtggttcacgcctgcaatcccagcactttgggaggccaaggcgggtggatcaccggaggtcaggaattcgaaaccagcctgaccaataaggtgaaaccccgtctctactaaaaatacaaaaattggatgggtgtggtggcgggcgcctgtagacccagctactcgggaggctgagacaggagaattgcttgaacccaggaggtggaggttgcagtgagctgagatcacaccactgttctccagcatgggtgacagagcgagactccatctcaaaaaacaataaaataaaataaaacaaaacaaaatattcttcttttaacagtaaggtttctaagtttgtgctgaaactcaaaatatagcttttaaaaatctccaccagtgcagcaagcttcaagagaaacaaaatgtatgactcacctctttgacaatattgtgggcttcctcagcattgaagccaacctaaagggaaaacaaaaggtaaagctgctttcaacacaggcttacaagtatgacgctacacagaatatcctaggctggcctagacaggtgttaaagtgttaaagggcatcaggtctacagaaggggccaatcttgcccctaaacacttaaaaatactgaatgctttccctacctacctcccgtgaggtctggggcagagcctgcaagtctacatttttttttaaaaaagtgctttatactggtgattctaatgaacatcctagattaagaatcattgtattgtaaaacgtaggaaataagcaagaggtgactatgaggatgttatgtgtcataagaatatagaaatggtttcagctaagtgagagaatgaagtggtccatatgaagagaatgcttagtagactattttcaattttgtttttaacttatgctaggcaaaaatttctaggcaaaaattcctttcccaaattaaagattatgaaaatacttgataactcaagattaatatcactttagtactataaagtggtctgacaacttagtcttttctttggagtccccatcaataacagggagataacaactgacatcatgggtttctggtgagggttgggaaagcctgagtcagtaagcaagggctcgtaatccataaagcacctccttgcctaatcctggcaagcattaccgggagcgggaatggcagtgccaccaggaccccgagactccgagccatgggggctgcagcacccgcgctgaggaagccaagggacggaggcagcagcgggaagacccgttttcgaggcccgcccggtaggagggcggcgcccgtcaccccatgcccactcctcgcacccaagtcaggcctcgtcctcccaaccctgccccgaccccaccgtctgatccgcgcgctcctggccacccctcccaccccgaatctcaggactttggggtggggagaacgggtcgggcggggcggatcccgggcccaggggagaggacccgggctcggaggacgccgcaccccaactcttgggaccgccctcgctgggagaccacccggcaagagccccgcgcagaggaaggcgggagtggggggcgctcccaggtagccaaggggcggtacctcgtcgcagtggcgatggtactcctccatggtagcgccggctctccctggggcggagcgacacgccggtagagcaccgcggccgcgcactggcctccggggaggccccacccccgtttatggcctagggcctttccctacgcaatccccgcctttgtgtcgcagtggcgtcacctggcagcgctgggcgggcttcgggcaacgccaggcgtcacttcaggccacgcactttttcctcgcttcctctgccctttctggaaacaagggatgaatgtaaagaactgggaatggcgccagtgtggatcagatggggtgacctagtggcagttagtctagactccgcactagtggttgagtgcccactgctgtgattacttgcacgtatttgttcattcaccatcatgtggcacataaatgtagttaatttcgtggtaaaccagccactttgatttgtccacttactagctatgttacttggaaaaattcacctcccacagcttcagttttctcatatggaaacttaccatcatacctatttcactactggttgtaaggatctgatgagaagctgtatacacggctcctaaagtagatgcttctcaacaagagaacaatgactacattttaaaataaatgtagtaattttaaattagtaattttaaaataaatgtagtaattttaaattagtaattttaaaataaattactaatttccagatgatcctagacacttcctcaaaacctcacaataagtcagaggagttagttcttccatcactgcttttatcaagatgaaactgaggtatagagaatttaatttgcccaaggtcatacagccagtagggtgtagaaaagggacttgagctcaagtagtctgatagcagagcccaagctcttaaccactgtattactttcctattgctactgtaacaaattaccgtaaatgtagtgccttaaagaaacacagtcctgttctcttacagttctgttaccagtgtagggtgtccaggttcttggctctttgaacaaagaattggacaaaacgcacaaacaaagcaaggaaagaatgaagcaacaaaagcagagatttattgaaaacgaaagtacactctacagggtgggagcgggcagagaagccgctcaagggccgggatccagaatcttctctggtccaaataccccctagagatttcccattggccacttggtgtgcaccccatgtaaatgaagtagtggcccacaatcagaggctgaagttacaaaggccacactcctatgcaaacgtctgattggttgcaagaaagcaaccatcagaggctaaagtgaagttacaaagttgcacttctattcaaacaaagatttggcccataatcagtttgattggttgcagacagcaaccaatcagaggctgaagtgaagttacaaagttccactcctgtgcaaatgtctgattggttgctttttgctctttggttgcaaaaagcaaccaatcagaggtactttaaatttcccatctgccctgcagaaaaggtggggatttgcaaagggaatagcctctggtccttttgttacttaggcatggaaggtatggaaggttagggttttccttttttttttttttttgagacggagtttcactcttgctgcccaggccggagtgcaatggcgcgatctcggctcacccacggcaacctccgcctctcgggttcaagcgattctcctgcctcagccttctgagtagctgagattacaggcatgcaccaccacgcccagctaattttgtatttttagtagagacggggtttctccatgttggtcaggttggtttcgaactcccgacttcatcgacctcaagtgatctgcctgcctcagcctcccaaagtgctgggattacaggcgtgagccactgtgcctggccagggttttcctttcaatttagttctatgaagtaagcgtgaaacagttttaagttccctgcctcctgaccctattctcctgcctcagttctggaggtcagaagtctaaaatgggcccatagagctgcatgccttctggaggctccaagacagactctgtttctttgccttttccagcttctagagattgcctgcattccttggctcatgaccccttcctccaaattcaaagccagtagtatcttttctcctctctcgcttctgcttcaaaggaagtgtgaggcatctctataaacgagagatgtatgactcttgccctcctgtttccctctcaagacccttaacttaatcacatatgccatgtgtcttttgcactctgtatcatattcacagattctcagaattcagatgtggacaaatttgagggggagcattattcagccaaccacaacacttttctattttgctccccagaatcaaagttggaaaccattagtcttctagtccatctcccttattttacaagtaaaactgaagctgagaagataaagtaacttctacagggcacataggtgttaactggactcctgggcttctgaacctcaggctcttattttatgaacttagaaccaaacaaggctgtttacttgatagtatggtgtttgttattggttctcctaagttgtggatcatgcagggttactgcagaaaagtgactgtaattcatagaggaagcacatcctctttcaagaattttttttaccaaagttttcatcctatgagcaactccggcagtctattcatgagaaggattcgtagtgtctttgtgaacatcagttttatttccctaaagaactgtttctatgcctgggtgggttaaaccctgaagttacctaatcttaatactgcaagagctacaccagcacatctcaagtttgtgttatgtgatcattcatgatgcatataaagtgagatgaagaagtgttgttccagttaccattcctgtgtaataaattaccccagaatttagcagcttatttactatattatgctcatggattcgtttagtcagaaatttgaacaaggcacagcagaaataatttgcctctgctctgtgatgtctggggcctcaggtggggagactcaaagactggaggaaattcaatggtggggaccagaatcatctgaagacttgttcattcacatgtctgatatctgggcttggatgaataaaatattagcacttccaactggagcaacaacacatggccccaccgagtggattggcttcttaccatcatggcaaccttagggtagccagatcttttacatggcaactcaaggctccaagcatgagggttccatcgagcatggcagaagatatgtcaccttttatcacctagtgtcacgagttacacagcagcccttctaccatactctaatcattgaaacattcactcagattcaaggggaggggacacataatccacttctcaatgggagaagtgtcaaataatttggggctcatgctttaaaactacaagtgggtttattaactagcatcctgtggttgcaagtaacagaagacccaaataggatgagctgaaataatggcatttatttttttatataaccagactgatatggtttggatctgtccccagcaaatctcatgttgaattgtaatccccagtgttggaggtggagcctggtgggaggtgattggatcatggaggcagatttctcatgatgggtagcaccatcccctcagtgctgttcttgtgagagtaagtgagtgagttattatgagatctggctgcttaaaagtgtgtagcacctccctcctctctctcttcttcctgttctagccatgtaatatgtgcctgcttccccttcaccttccaccatgattgtaagtttcctgaggcctccccagaagcaggagtcactctgcttcctgtgcagcttgcagaaccacgagccaactaagcctctttacttcataaattatccagtctcaggtatttctcattgctgtaaagcaatgagagaatagactaatacacagacatacagaggcagagatattccaggttcgtttagttgctcaacaaattttggggcttctgtgcttttcatctttccatgccaatatcctcagcatgtcagcaacatttagcctcatggtcatacacggctgcattagttctggtatcgctaggaacaaagatatcacgttcagtgactaagatgagcattttctggggttgatcggattttcttaggaaagaaaatctttatttcaagtcctcaggagttttctcctcaggttccagtggccaagattgggccacgtgactccccaccgggcaaaacatatgggacaacaaatgtttgttttttcattctgtatggtgaaaagtgagttctgccagcaagaaaaaaaaaattgatataaagtaaatgttggtaggtcagtcctttccaaacttttccatgctatggcccacatagaggataatacttacatggtacattgaggtaaactggaggggcttggtgggcatctgtatggggcttggtgaaaaaatattttcattactttatataattatatgaaaaaataaaatagaaagggtgttaaaattgaattttttaaagcttccaaataaaacctctttcaatgctttagtgagaccctcaatcttggtttcacccatataatattttatatctggctctacgcattgaacagccataagcaattcctgttaatgagtttttaataattaattttccctaaatatgaataaattatattgtctagaaaggtttgccatagaagcagctgataaaaaacatttggacccactttacaaaccactaaaattatatttaaagacttctgtaatggtagactatgtaattaggaccatctctttcactgataattacaaaggttggacaaaatataatagacatttgctcaagggaattggattttttaacaagatagggaagaattatggatctaagacatagaataatgaaacccagaaagatgagcatggcatttgggataactttttacctcgaggtgagaagatgttaagccttttgcttatgggccaaggggtaaaataatcagactgcatgtcctgccaaggaagatgattctggtaaacagtcttgctttgggttgaaaccccatggattaaaccctgggagtgaaacactcaaacttgatcttgcagactgaatctcagttttaaattacccaaacccctaaaattgaattaaggtgatccggaattgctaatgcctctagccaacttctagaagccaatgtaaattctctctgaaggaagaaaacattatcttaggtctcaaatcagacatatgattttttgcatacatcaagtggacaataaaatataactagacacataacgagacaaaacaacattatcttaaatcaaaagacaatggaaacagcccaatcagggatgaagatgatggagttatcagaaatagactttaaaataactatgcttactatattaaaagagataaaagacagggttgagaatttcatccaataacttgaaattataaaaagtatacaaatggaatttctagaagtagaaaatacagtaaccaattttttaaaaagaacaaagaatcgattctatagtggttcctacaaagctgaagattaagtgaagcttaaaaaattggacagaatagaccggggcgcagtggctcacgcctataatccgagcactttgggaggccaaggggggcagatcatgaggttaggagatcgagaccatcctgactaacatggtgaaatcccgtctctactaaaaatacaaaaaaattagccaggcgtggtggtgggcacctgtagtcccagctactcgggatgctgaggcgggagaatggcttgaacccaggaggcagagcttgcagtgagctgagatcatgccactgcactcaagcctgtgtgacagagtgagactttctctcagaaaaaaaaaaatggacagaataaaatagccagagtaaagcacagagacataaattaatgtaaaatacagaagaaagcatacagacaaaagtaataccatgagaaagtttaacatacatagtgagatttccagaaggagatgagacagaatggacagaaacaatatttaatgaaatattagctgaaggtcttccaaaactgatgaaagaacatattagtcagagtctctgtaggaagcagatgaaactcccaaaatattaattcagggaggatttatttacaatgctgtgtgctgggatggtggatatagcagatctataaggaataggttcaggaatccagtatagcctatcacttttctccatcaatatccatccacttgcccagctacagaggcaaggactatagcaactattctgtgttacttcatcccctctcccttttacctccactgatcatagctaatgtttttgattgcaggtggttgtgtgaccaacttaaatgctataatagatgatgcacctcctctatatgtcaagcagcacattttgtgctctacatctactatatttccagggactctgtgattacagttccaattaatgtcaacaatgtcatggatcaatgtgatgtggtacagctctaagatatgagggactcccttaaatctgacgtggaggtcttctagttttttattattattatttatttattttttagatctagtcctgaatccagactttctagttttttaattcatgttcttcatttcatatttataactcttatattttccctatctgtactttctaaagctataataaagcaccaggtgactccacaatctttataagaaactttgttgctatagagattaagcgctacagccacttgacctccagtgccttgccctctacctgcatcacatcctctgatgataaagtgagtaatcattatgccacatcgtggtcatgaattacatatgccctatttcttcccagtaagaagattatccgtgtgctcctttaagtatatgaacaaccaattctcagaatttcattttgagtatgtgtgtatataaagagatttattttaagatatttaagagtcacttatagtttcctttttttgaactgtttcttcctatccctttcccattttcatacttgttgatttgtgagaactttttataaataacaaattatccttgtgtttgtgatgagttacacattctttctcccagtttttttcctctttttattttgcttaagataattgttgccatacacacttttaaaatatgaatatcattaattttatcaaaaaatacttattctaagtaattggctgacacaattgtagaagcttggcaagtccataatctgatgaggtagaccaaacaggctggaggctcaggaaagggttacagttagaatccagatgcagcccgatacagaacaaggaagtaccaatgttacagataaagtctgaagactatctgctgaagaattcccttttgctctggggaggtcagccttccgttctagtcaggccttcaactgattagataaggctcacccacattatggaaggcaatctgctttactgaaagtctggtgatttaaatgtaaactcaaccaaaacatcctcacagaaacatccacaataatgtttgaccaaatatctgggcattgtggcccagccaagttgacacaaaaaattaaccatcacatgctacttctggtaccagttactgtatcaatcaagttgccaagaagaagcagatggcacactaaagttggcataaattgaagagtgctcatttacaaagatgtgggcaggtgaactaatggcaagtgatagtgaaagaacatggggctaacaacagtgaaattgtcactactcctaagctgtgaagtttgaggggaaagaggattaaacagtcatgttgacaaggccactttaagaggaaaaatgatcttttgtcaagggatataacaagcccgaggtggcctccacaaagggaactcggggaataattatcctgaccctttctccttccctctgatctcttattgctgtttctcattagctgaacccaactggaaactagagggcataggaacgactgtaatccatataggtcagtttcccaaagcacgaaggagtgtggactgtgtatggggagagacaaacagaatacttagcatagatcttaagccacaggtccaagaatccctatgatccccaagcaaaatgaataaaaactgtatttttgcacctcacaataaaatggctgaaaaccaaaggaaagagaaaaattgtaaagtatcactgcctcacccaaaaagacaaattaccttcaaaagtgagacaagaagattcaaatctgacttctcatagaaacagtggaaactcaaagacaatgtatttttaaattgatatccagtaattgtacagatttatggggtgcacagtgacattttgagaaatgcataaagtgtgtcatgatcaaatcaggagatttaggatgtccatcaccttgcacatttatcttctcattgtgttggtgtttgggccgtttttgcattgctataaaaaatacctgggggagcgcagtggctcatgcctgtaatcccagcactttgggaggccaaggtgggccgatcacctgaggtcgggagttcgagaccagcctgaccaacatggagaaaccccgtctctactaaaaaatacaaaattagctgagcatggtgatgcatgcctgtaatcccagctactcgggaggctgaggcaggagaatcgcttgaacctaggaggcggaggttgcaatgagccaagattgtgccattgcactccagcctgggcaacaagagcgaaactctgtcttaaaaaaaaaaagaaagaaagaaagaaagaaaagaaatacctgaggctgaggctgggtaatttataaacaaaagaggttttaattggctcgtagttccagaggctgtacaaggcatgatgctgggatctgcttggtttctggggaagcctcagggagcttttactcatggtggaaggtgaagcaggagcaggcacatcacatgaccagagcagagcaaaatgagagggaggtggcatacacttttaaataaacagatctcatgtgaattcacacactatcctgaggacagcaccaagccatgagagatctgcccccatgatgcaaacattttccaccaggccccatatacaacattggggattacagttcaacatgagatttagagtggacaacatccaaactgtatcattttacccttggcccctcaaagctcatgtttttctcacattgcaaaatacagttatccccgccagtagtcccccaaaagcctcaactcctttcagcatcactcaaaaaagtcccaagttcaaagtctcatctgagacaagacaaatatcttccacctatgagcctgtaaaatcaaaaattagttatttacttccaagatacaatggaagtacaggcattgggtaaacattcctgttccaaaagggagaaatcaaccaaaagaaagatgagccccattcaagtctgaaacaaagcagggcactcattaaatcttaaaactccagaataatctcctttgactccatgtcccacaatccagagcacactgatgcaaggcgtgggttcccaaggccttgggcagctctgctcccatggattttccacactgaagttgcaagctgttaatgggtcttccattctggggtctggaggatggtggtctgcttcccacagctccacaaggcagttccctagtggggactctgtgtggggtctccaatcccacatttcccctcctcactttcctagtacaggttctctgtagggtctctgcccatgcagcaggcttctgcctggattcctaggcttttccatacatcctctgaaatctgggtgaaggctgccaagcctccttaactcttgcactctgcatgcctgcaggcttaacaccacatggcaactgcctaggtttatggcttgcaccctctggagcttgtggcccaagctgtacttaaaaccctttgagccaaagcaggagtttgggcagttgggatgtggggagcagtgtcctgaagctgtgcagggtaatgaggcctccagcctggcccaggaaccattctttcctcctgggtctctgaacctgtgatgggagaggctgcctcaaagatctctgaaatgcctttttttccccattgtcttgactattagcacctggttttcttgtcatgcaaatatctctagaaagtgattgctccattgctgtcttggattcttctcctaaatcttcagggctttctagatataagatcatgtcatcttcagagaggaacaatttgacttcttcttttccaatttggatgccttttgttcctttatcttgcctaattgctctggctaggactttcagtaatatgttgaataggagtggtgaaagtgggcatcctagacaatgtattttgacaccttcaaaacactgaaagaaaatactctgaacttagaatgtctatacagcaaaaaacccttcaaaaataaagacgaaataacaaaaatttaggcaaatataaatgaaattagaaattagttaccagcagtacattccaagaaatacaaaaatttatacttttggcaaaatacaaactaattttagatagaagtttgggtgatgtaggaagaaatgaagagtaattacagggctacatttaatgattatgaactctataaaacaatgataataatatctgtggagtttaaagtatatgccaaattcaaatacaggataacagtagcatataaattgagaggaggctaaattgagttaaagtgttcaaatgtccttttattgttcaagaaatgggtaaggtatcaagtaatattatactttgataaatcaagaatgcatttttgtatagagtaaaatgcacaaaatgaaaaattttttttcagtgtataattaccaagctaacagagtagagaaatagaattttaacaatactcagttaacccaaaagaaggcaaagaaggagagaaaaaaagaacatagtaaaagcgagataaatatgtaaaaataataaaatgatagatttaactccaaatatatctgatttataataaatataagtagatcatacattccacttaaataaccaaggacagaacaaaacacactccacctatatgctgattataaaagtcacataaaaatatcaaggatgcagaaaaatttaaagtaaaaggatgcaaaatgaaacattatttaatgctggcatatatgttttaatagcagataaagtaggttttaaggcaaaagacattactagaggaaaagagacacgtttcataatggtaagagtcaattcactgggtggacaaaagagtccaaagtgttatgcacttaaatatgggaaataaaaatgaatacagttaaaagatgaaaaagataaattcacagttgtatggaagattttaatgctcctctcaatagatgacagaataagctagcaaaaagtacattagaaaagataaaggaaatgtgagcaatatgattaacacattttataattgatgtgtgtagaactctgaatacaacaactgcagaacaattcttttgatgtacaaaaagtactttaagtgaaatatattatcttgcttgaggaatttaatcattacttttatgaataatgattgtaatatggtgatagataatttgtctatttgttttgtagctagcagtccttcaatttcaaaccatagagaaacatatactcccataagaaaacgttccgggaattggaaagtatttattttgcttcaaaacgattcatctttgagaaccagagtttattgatcgagttacaaagtaccattttgggagtgaaaaactttgtggatttgaataagatacttaagatcagttattaatgttgtcactagtaggccatgatataagtgttcatagaactctgtaatttaaaatgcaaactctgcttccctacaggctctgttgtaggcaacttcttctatcattcttttgtttctagtatgtaaggcactgtagtcaagactcacacgtagtactatttcaaagcctttgtaatatctggtcccagtatggcaaaatgagttttatttcatagtacaagccattattacaaaagaaaattgcaaggtaatacatttttttaattaccagaactaattatcaaaaatagaacactaatttttaaattaccttacttaggatgaatatagatctacaatggggcagggaatagaagatataaatggagcgggaagttactgtgctgagatatcctttctttcatttccaaggaattgatcactaatgtagatatttgaggagaaatgtattgacaatgaggattgctatgctgtaatactagtctttggagaattgaaaggaataggattttaacactggctgcaaatcagaagcacaggatgaggtgttaaaaaaatttttgtgctagaccccacccccttgagattctgatttaattgttctggaatcaaaactggcatcagtagtttttcagaagcttccccaggtgggtgattatgacatgtagtcagtcagggttgagaacccttggtgcaaaatcttttcttccccttcagatgtcattacaacaaggtaaattcacttttgctggacaggcttaaacatagttctgctggatgttagaacaatacattctgctacttcttgggaatgtttttgtgtcctatgggtttgtcatttattcattcattcattcaacaaaggtttacttagcactctctattgccaaacattgtgttagagaggtagtccttaaccagggcaggtttttaccattgcccccacctccaccccagggagatttggcaatgcctggagacattttgattgtcataagcagggtgagacctactggcttatagtagttagaggccatggatgctgccaaacttccaacaatgcacatgacagtcccctacagtaagttatttgccataaaatgtcaataatgctgaggttaagaaatcctgtattagaagatgggaatgaacaagaaagattgcccatctctatggagtttatgatctattaggaaaggcagacaatacacaaacactatatatatatcatatatatatatatcacatatatttgtcatatatagatatatatcatatatacatatgatatgtacataatgtgtattatatgacagcaggaacatcgccatcttgggcaagcccttcattctaaagttcacctaataaaaaactgcctaaatccaaagggcatcagcctaatggctaaggtcagcaagaccataaaccacaaataacatctccaaccagaaacattccaaactcctccccgacgagagacatgctagctccgagatcacctccctttggccggaaagatgccagcctcaagataaaccccctccagccggaaagatgtctgtcccaaaataaactcccctcctcccagagacattccaaccctgccataaatcctctccctcacactgaaacattccaagctagtgataagccccctcaccctaaaacaaatatattctcttagtctgtaagagaaagtgctcctgaccaaaattggccagaaacccctctcatattttatctaaagtaaaggtgtctttaactgccaatctgtgtttcatgtttctttcctctttctttaactcttacattatatatatatgtgtgtgtgtatatatatatatgtgtgtgtgtgtgtatacacacacatgacgaggtagctgtaagtgttataaagaagacgtaagaaaagtaagggaatagagagtgactagggtgaggatactatagataaggtgaagagggaagagttctctgagaaaatgacatttagataatcactcaaataatgtaaagaagttagacaagaatttgaaagttacattagaagttagatttgaagtttgacgttacatgagagaggacgatggattttctcagagtgtggggaaggaaataaattagaaaaatatggtaaaatctcaggcaactcaattgcgttttgtggtcataattttaaaatgaaacctatcatagatgttgcagcctctggccatgttcagctcttggaagcatatggagaagagtagggttaacccggattggggcttttccaagtgattttgactgaggaagagagaatcatggccttcaaaggcattttcaggggagtgattggtctgatagcttgtggattctaagctcggtaagtagtgatggacagcgaaaaagtgataggatcattgaactgtaggtcaaaatggtgtcagataattactggggtgaaggttctagaaaaagtgagatggaagcaaagagagtaggggtcagaaagttggatgattgaatatgaagtatatatacatatttttttttgttgttgttgttttttgagacagggtttctctctgtcatccaggctggagtgcagtggtgtgatctcagctcactgcaacctctgcctcccaggttcaagtgattctcctgcctcatcctccagagtagctgggactacaggtgtgcaccacccacccagctaatttttgtatttttagtagagttgggattttgccatgctggctaggctggtcttgaactcctgacctcaagtgatctgcccacttcgccctcccaaagtgctgggattacaagcatgagccactgcatctggatgaacataaaatatttttgaagccaacatctaagcaggagtgaggattcctcttcttcttggtgcctcttttatatcctactgtgggcattgtagccaggagagtggtacaagaagctttgtattatcagctgggggacgttattatcaggttccatgattttgacttgatatctttcctggctttttcatatatggggttgtgagtatgagtgaatagggacaactgagtacaaatcctagagtacagtgccatgataaacatactgggcagggggaaataagcaggcaccaaggaaaaataggaaataagacttttccatataggttgatcccttttctccagacgttcatagattctatatgagacatcttatatcccttcttttttttttgcctcctgcccttgtttctgccatacaattttattatgctttagtatttgttcatgtaaagatgaaattacatttgtgcctcaggcatgctctgcctgcataatcacaataagaatgtttttggctaaggtttggaaaacttagtttttttgtgttttggtccctcttgtgcccaccatttctagtgaaggttgtgattttttaaccatttatttaactaaaaattctactagtgttgtggctaatttatgccccacctcatcctcatattacaatctttaaacaaatatcaaactgagaatatttccttccctcacagagaaaaaatctgttttttatttagtgtctgtcttttagtggaaagaatgctgaccttttgatacagggtacataatctgaccctgttgtttattataatgctttattgcactgaaggggcatatgaactggataagaaaagcacatgtactgcatgaatcagttcagtactgtttcagggaaagaacacatgcaaggagatccatttagttatactcagctcttaatttctgtgatccttctaaaccatgtctcacaaaagatatttcctggtgtttttgaagagctggagtaatgtatttactagcataaaatggcttcattaggtatagccattttgttcatcaaaaatctgcagctttatcacagggaatcattcattgtcaaagtgcatatgctaatgaccttcttcatagtcaaagcacattttaagtatttattcataagccagatgaggacttttaaagtagttaattttaaaacaaagtgacctttgtacagggagggaaaaaacattgaatatgaacaaaatgagcatttgtgtcatggttttacacataatagagtatttgccaagcatcagcaccaatcatgtatacttattcaacccatgatgcagccctggttttcaaaagcataatcaaatataaacatatatagattgacctcagttgacattaagggattgtggatagttttctccttgtaacaatcataattatattctattctccttaggtaaagacatggatgatgtagatgttgaacaaggtgctgaagcaacatgattatacacatttctcattcctagtgggctgtttcaaggtataaaaattagaaataggcactgattgaaacattcaagtctcagttttctccttctaaacacagacgaagacttggagaacaataaaaactgtttacaaagggttttctatccacatggtcttatctccatattactctgagttaatgtttgatagaatgggggtatttggagccaagagatcgtcagtcattatagtgaggacatcaggtcagtgtggtgggattgtatttaaatttgtatgaggccctcactgagggcttttaactaggataatctctcctggagtgatttcggcatttggtttttggctatttctttcaggaattgtcacaaagtgaagaaagctgtaatctttctctgattctttgttggttaaaaaattaacccagctaaactcttgaattgatccaattcattgacttttctccacctaaatctaggctggttgaaaatgtctctcaatgaacagactagggctctgtaactctgtggtctgcatccacagtggggttctcagagcaggaggggaaacctctgatgattctctgatctgttcagctttggttctccaccacagccatttcaaacattttcccactctccacctctctgactccagaacattcctgtcactatcaacatattgcttcccactttagcaagaaactggatccatcatttgagggctcctttaacttcttgtcattgaatgaaagaacacacttgcatgcctagctattatttgcttcccttataacagagtggtaattcttccacaggttctttgacatttgttccttctatcttattcgcagaccatggaatgacatttttcttctttctcctttgcttttaatcccactccttccagtgtttattgtaactgccaaactgcttatcttgtatctcttactcaaatgtaaaccccataagaagcagggaactggtctatcctgctccccattgtatttctagtgcaaagatctatgcgtgattcaataaatgtttttgtttttaaattaatgaatgagagctaagagggttgtatggtgaggcaaactggtattatagaacacaaagtgttttaaagttcaattgcagtggggtgtggtttgtcccatgtgtaatcccagcactttgggaggctgaggcaggtggatcacttgaggccaggagtttgagaccagcctggccaacatggcaaaactccgtctctactaaaaatacaaaaattacatgggtgtggtggcacacacctataatcccagctactcaggaggctgaggcatgagaattgcttgaacctgggaggtggagattgcagtgagccaagatcatgacactgcactccaacctgggcaacacagcgagactctttaaaaaaaaatgttaaaatttttaaaaaataaagttcaattgcaataattttggttttattgaggtcccttatgatggtctatactgataggtagtctttgatcaacaaatcagtggcactattagaagatttatctgtagttgcttgtttatttctaactcaacacagagtctatgtcctcatccagttgtccagtttatggcattcatactatgccctgttacccagagactgctaatgtgtaaatttcacagtaaatacttatcagaaaggtaggcaataacactcaacttgataaggaaaagctgcataagaaaatgttttgatagaattatgcttacttattctatcaaatttaatggtgcattgcataatatatgctaaataccaatgacatggttgaacatagtgtgctttccccactatattagcctgttctcacactgctacaaagaactgtctgagattgggtaatttataaagaaaagaggcttaattgattcacagttcaacatagctggggaggccttaggaaacttataaccgtggtggaatgcacctcctcacagggcagcaggagagagaataagtacaagcaggggaaatgccagacacttataaaaccatcagatctcctgagaacccactcactgtcatgagaacagcatgggggaaccacccccatgatccaatcacttcctacctggtccctcccatgataagtggggattatgggaactaaaattcaagatgagatttgggttgggacacaaccaaaccatatcatttcaccctggcccctcccaaatctcatgtcctcacataacaaaacacaatcatgccttcccaacagtcccccaaagtcttaactcactccagcattaactcaaaagtccaagtccaaagtcttatctgagacaaggcgagttcctttcacctatgagcctgcaaaatcaaaagcaagttagtcacttcctagatacaatggaggtacaggcattaggcaaataaatacacctgttccaaatgggagaaactggccaaaacaaaggggttacagggcccatgcaagtccgaaatccaatagggcagtcattaaaccttaaagttccaaaatgttctcctttgactcgtatctagatcatgctgatgcaagaggtggactcccatggccttgggcaactccacgcctgtggctttgcagggtactaagcctccaccccccaacccccggctgctttcacaggctggcattgagtgtctgtgggttttccaggtgcatggcatgacgtgtcagtggagctaccattctggggtctggaggatgctggctttcttctcacagctccactaggcagtgccccagtggggactctgtgtgggggctctgaccccacatttcccttctgcactgccctagcagaggctctccatgagggctctgcccctgcagcagacttctgcctggacatgcaggtgtttcatacaacctctgaaatctagatggaggttcccaaatctcaattcttttcttctgtgcacccacaagaccaacaccacatagaagctgcaaggcttggggcttgcgccctctgaagcaatggtgtgagctgtaccttggccccttttagccatggctggagtagctgagacacaaggcacctagtaccaaggctgcacagagcaggggggtcctggacctggcccagaaaatgacttttccctcctaggcctccaggcctgtgatgggagggcctgccatgaaggtctctgacatgccctggagacattttcctcattgtcttggtgattaacattgggctcctcattacttatgcaaatttctgcagccagcttgaatttctcctcagaaaatggggttttcttttatatcgcatcagcaggctgcaaatttttaaaacttttatgctctgcttcctcgtgaatgctttgctgcttacgaatttcttccaccagataccctacatcatgtctctctagtttagtttcacagatccctagggcaggggcaaaatgctgccagtctctttagtaaagcatagcaagagttacctttgctccagttctcaagaagttcttcttctccatctcagaccacctcagcctggacttcattgcccatatcactatcagcattctggtcaaaaccattcaacaagtctccaggaagttccaaactttctcacatctttctgtcttctgagccctccaaagtcacttccacatttttgggtatacttaatgcagcactccactccctgcagtactaattgactgtattaatccattctcatgccgctataaagaaatgcccaagactgggtaattaataaagaaaagaagtttaattgactcgcagttccatatagctggggaggtctcaggaaacttacaatcctggcagagggcacttcttccctgggtggaaggagagagaatgagtgcaagcaggggaaatgccagacagcatggtgcaagctgccagtggatccgccatatatgatgcttatatatcatatgacgcttataaaaccatcagatcttgtgagaattcactcactatcatgcgaacagcatgggggaaaccacccccatgatgaaatcacttcccactgagtccctcctatgacacatggggattatgggaactaccattcaagatgatatttgggtggggacacagccaagccatatcacccaccaaaaatacattcagccatttacatataaaatgaaagtgaaagtacaaaaggtcaactccaggaagcaatgccatccactaagtgagaaaacaactatttaaggtctatcatttagaggttatatttcaggttcaaataaaatgaatcattcactcccagctagtatgtatcatgttgtgaatctttcttgaagaggagtaggaggaaaagagcagcataaaatctggttgcatgtcacctttcatcttagtagtctaaaacaaattttggtgttatgtctttgcccaacagactatgacttgcttaaaattttggaacaaaatgaaatgcatgctacttttattttaaataattatttcaataaatgtttgttgatagcctgttatgttctaacactggcctggtctttgaagtaagaggagaaaagataaactgatgcttcaaccgggctgattcttggagaagctgtagatgtgaatgagggtaaggaaggtggaactgccaggaaaaagtaacagaatgcatgaaggcatagaggcatgaaaaagcacgtgtggaaaattacaaatgcttcaatttgtctaaagaagggcatatatggagatataaatttgagaatccttaatatatagggggtagttagatcacccaggaggagtatgcagagagaaaaacaaacacagaggctgacatattaggaaacgctcatatccaagggatgggatgggcagtagaagagtccttaaaagatagataagaacaattatagaagaagtgatcacatgcacacatacacacacacacgcacacacacacagagagagagagagaaacaaaaaaggtaatagagtaggtaaattgcattaatggctaatttttacccctccctatattcattcccgttgtcctgtacattttcagtgctcttctactctgactctaggctcaatcatacggcatactttagccagtgaaatgccaggaaatatgacaaaaacagaggtttgaaaagcagcttgcacaatttgtcctgtactcttatgtctctgccatgagaaggacaaacctgggtaggtcactgcccatagcagaataagttattctcagctgagcccagcctagatcaaacaacccccacctaacccacagacttgttttgtaataataaacgattgtttttcattagtcactgagttttggggtggtttgttatgcagcaatagttgactaatcacagttttcaaaaagagagtgaatgacaaagaaagaaaatgagataaagattgaaaagagcacatttaattgggtaattagaaggattctgcttaccttaattagggcaaatttaatggagcagtgggtttgaaaccacaactgcagaagatttgaagagtgtaaaaatagaataatctactgttttgtggagacagactaaacgcaatgtggagaggtagagggcgataggtagatgggtatgaataaagagaaagtgtgttgtttgaagattgtggagatataagtacatttatatgcttaggagacaaaaccagcaaagagagagtagttgaacaaacagaagaaggaacgacttaggcagagtgatctctgagcaggtagaaggcaatgaacactagggcacagaaaaaggaattagctttgcttagaagaaggggtatttctccactgaactgggaatgtaaaaataaggatgggaatagataaagataagttttcaggaaagaagggagtgggagaagaaaagtgaaatggagttcccatattatggcctctatataaagtacaaagtgatattgggtagggcattctgcaaagtcacattgcaaagagtaagaagaatgataaacattaatagctgttactaagtgaagacagggaagatttactctagtattgaggacatactaaagctgggaatgataaatttgtagtggtaaaaatgcatgcttgtatgatttctctagaaggactttataattcaagtctaagagaagatgggcgattgcagagattctaatttgaaatatttcaggatagtgtgatagaaggcaagagttaataaatatagaaggaacaggtgggcgcggtagctcacgcctgtaatcccaggactttgggaggccgaggcgggtggatcacaaggtcaggagttcgagactagcctgatcaacatggtgaaacctcatctctactaaaaatacaaaaattagccaggtgtgtgctcgcttcggcagcacatatagtaaaattggaacgatacagagaagattagcatgtcccctgtgcaaggatgacatgcaaattcgtgaagtgttccatattttttttacactgttggtgggactgtaaactagttcaaccattgtggaagacagtgtggcgattcctcaaggatctagaactagaaataccatttgaccctgccatcccattactgggtatatacccaaaggattataaatcatgctgctataaagacacatgcacacgtttattgcggcactattcacaatagcaaagacttggaaccaacccaaatgtccaacaatgatagactggattaagaaaatatggcacatatacaccatggaatactatgcagccataaaaaaggatgagttcatgtcctttgtaaggacatggatgaagctggaaaccatcattctcagcaaactatcgcaaggacaaaaaaccaaacaccgcatgttctgactcataggtgggaattgaacagtgagaacacttggacacaggaaggggaacatcacacactggggcctgttgtggtgtggggggaggggggagggaaagcattaggagatatacctaatgtaaatgatgagttaatgggtgcagcacaccaacatggcacatgtatacatatgtaacaaacctgcacgttgtgcacatgtaccctagaactaaaagtataattaaaaaaaaaattagccaggtgtggtggcacgcatctgtaatcccagctactcaggaggctgaggcaggagaatcacttgaacccaggaggtagaggttgcagtgagccaagatcaagccactggactccagcctgtgagaaagagtgagactccatctcaaaaacaaaacaaaacaaaaatccagaaggaacaaatagggaaggacattgtatcaatataactttacagtacattcgtgagcaacagaaaaccttaccatatgtgataggttaaataagaaattatttttctcatacaacaaaaatcctgaagaaggggcttagggtcgtgttttgactccacagtaacatcaatatatcattcttcttcctcatcctttttgcatggcttttatttttgttgttgcaatatagctgctgaacaagggcatcatcccgtatgagttccaggcagaaaggaggaggaaaggatcaaaagctttctcttaatgaagtgttactttgggagggcagttttccattaaatctccccttaacctctttggacaaaagtgtatcacattgcatctcttgttgcaaagaagaccagaacttcaaagctttaatattctagccactataatagagggaggcccaggaagaggggtttgatgttggagttaagtgagccaatgattagtgtctatcatataagtgagaccaacaggagctgacatgttgcaaaaaataaaggaaccaaggatagaaactaaataaatttgaaaatcagatgtgatgagacatgcgaggaggctaacagatgttggagattataatttctggtgtgaagcaatttaggcaagaagaaatggttgttgaagagtcatagggtttaagtttcttggaattcagaaggtcaagaaaacatcaaactagaaaggatcttccatatggatattgacatttcttaagatgatagagggacttgcggttttagtaaagtaaaaagttagtctataataaaccatatcctcttctgaagattacatcagaatgaaaacatgtcctgttgcacattcttaaaccccaaaagaaattagaatgacttaaatcgggcagcagttcccagagaaagttaatattcactgacatatcaattaccgatttctttgtaataaaccaattcaaaatgtaatgacttaaagcaacaaccatctataatttttcagaagtctgttggttatctgggtgattggagtcttgctaatttcggctgcactcagctgattttggcttggctcattcacatatctatgttcagctggtgagtcagctggtggctggctggtctaggttagcctcagctgggatgactaagctctgctcctcctgctctatcatctttcaccaggctagcctagacttatacaaaggaaagaatccaagagataaagcagaagtaagcaagatttcttgccacctaggctcagaattggaacaacattacttcttttgcattttgggcaaagcaattcataaggtggttagattcacaaggtggttagattcctcttggtgggaggaatctatcacattgtttattttcttgagtcattattgtaattcatggccatagaaagtctgactattatatatacttcacgaaaataagcataaatgtttagagcttgactaagtggcttcttttagattagtcagattggattatttgaaatgtcagtggtaacagtgataaacatggatagacatacctcatttagaattttgtatagttttttttctttttcaggttgaattgctaaccctagtagctactatgcatattgagctcttgacacctgtttaataataattttttcatcatctcccaagccatgtaataaagtacaaactcatcattacattgtttggctaccatgtgcctgatttatcaggcaaatttttagaacactggtgaagctcgagcacacagtaatagcttcctactatttccatgagaacgataaaagagagagaaaaaattttttgtaaatccaacgatccttcacatgtctgaaacaaacaacatcaagcctgtttttctcaaagctgtgcctaccaaatgttcccctgactgtgtttgccccaatccagagcacacacacatccaactatgtccacatggctcatcctctccctgcttctttttgcctttcctcttacccaccctccaagttagctctatatgaatgtgggtttggaagagaaagaaagcagaacactcagcctgttttctctggatgaatgagtttcacaaacaatgacactccccaatgccacaaagaagctgttaccaggtgtgggacctgaggagaaatacaactcccgtaccagttgttctttgatgcaccacttcaggagccatgaaacagaggaaatttaagatcaatcatagctcttcacacagttccataaaacattttttcccttgaaagtcactttacttctaatgatacttaccatgccagtgtgttaaaactgtcactgaatcaagctttttattaagttgtcagtgtatccagtgtttcacagaacctctgtgggggactttcttgtcttttaaacctacacatctttgccacataggctttcctccataattagcactgacaggttctctttagaggaaatatcccactctcagagtacaagaggtagcaggtgggtggaaatagatttgaatcatttatgagacagggaaagggaaaccaacagttttcatggcatatggctgtgaagagaatattgaacgaatgggttctggacaagtgaagtcatacaagtcaacagtgaattgaagtaataacacaggttacttattccaagagagctgcaacattttggagtgagattttccccaattcaggatcacattgctgagtacataaccttagtctacatttctgtggtctgagactattctgggaaccataatattaccctgtggccacccatctatggaagtcttggcaagtcagagcctcttggtgtctgggtggtttctataggatatcttcttccttggctctactgatttttatggcactaaactctgaacacccattcagtttcctgtccctttccccatcctaataggctcaaatttttaggaaaccatgagtctaccctcatatcactagaaattcattcacttagcttaaggtaaaattcaaattcactgaatgtcctttgacataagccaggtacatatttggtggttttagtagagccagcccagaaggttcccatctatgtggcatgatctgagatggtagactttgcctacaacatccagatatttgtaattcatgtgaacagcttgccagggaatccaaagttcctactactggagtaaatgatccttttcgccagatctaatctgtttctttttcttttcttttcttttctttttttttttgagatggaatttcactcttgtcacccaggctgttgtgcaatggcgctatctcggctcactgcaacctccgcctccaggttccagtgattctcctgtctcagcctcctgagtagctgggattacatacagacttccgccaccacgctcggctaatttttgtatttttagtagagacggggttttgccatgttgaacaggctggtctccaaactcctgatctcgggttatctacccgcctcggcctcccaaagtgttgggattacaggcatgagccactgcgcccagccctaagtttcaaatttaaaaattcacttaaaatttccatttaaattcaatatggtatagaaacataatattataagttaagatagcatgctgtggacttcttatttcagcgctaacatgtaaagagcttggaaagttgtcactcccatccttatgacaggaaaaggtgaactaaaaatcaatgattttttcttggacccatcagagaactgaagtacagggcaaaccatcaccctgaaatctggagagatgggtgaattaagagagtcacagatgaggtctgttaaccaggagcagaagcagctagagccataaaacggtaggaatacttaaatggcaataataagaaattgctagaggtagagcgtggactaaaatgaaaggaagaaacttctgggatgcagtcttatggcgggggggtgggatccatattttcttgagatttacctccaggatccccaccacatacttatgggaaaaaaattgagcatgatctcctggtggctctggtagggtaaaaggaagagcaaccatcttgaaatatgcccagggtattgtatatgacaaaggcctaatctccaggggaaaagacttttaaccaggatcttattccaagttaaggaagggcatttttcctactccattcccttctagcatttctctctcacaagaggagaaaaataaagccaggaaacactggtgatggtcacagcacaaaggtacaggcctattaaaagattaagatttcatcataagtttgtagaatgctttccctccccagtaccttaccaccacaccaataggagtctagtaaaatggcagtggattttagctgaaatagcagcaagatgcagactctttgaggagtattagggaagcccaaagtcaacaggggaggcaaaaacaaaaacactagaggaatttgaagcctcagacacctatagctacagcaaacattaaacacagaccaacttctagccaggttaacgtgaacatttacattaaaggcctatttgacataatttctattttctgatacattatgtctggcttttaacaaaaaaatcaagccattctaaaaggcaataaaaatcacagaatgtagaaacaaaacaaacatcagatccagatctggttctgacaaagattttagaattatcagacagtggatttaaaataactataattaatatgttatgggttctaatagattaaaaaaatagataaaaacagacaacactcaagaacggttgcataatttaagtagagaagtgggaactcttagaaagaattttaaaaatgctagagatcaaaaccactgtaatagaaatttaaaaatgcctttgatgatctcattagtatactggacatggccaagaaaagaatcagtgagctggaagatattgaaatttcccaaaatgaaatgcagagatataatgctatctgaaaaccttcaataacatatcaaatagtaattttatcataattatacccatcaaacagttaaaacatgttttaggaagaaatatgagattgcataggggccatgtctttcaacagaaaaactatattggtccataaaatgtttcagtaagttgattacttataatcaattatttctgaaataggaggagggttcttagcaaaagcattaggtagtgtcttatttcagagaactggaattattgttatcagcttctgtatattgctttagccgttttagcagagaataaataacaatggctttaacgagaaggaagatttgtttctttttttttggagatgggtgtctcgctctgtcgcccaggctggagtgcagtggcgagatctctgctcactgcaagctccgcctcccgggttcacgccattctcctgcctcagcctcccgagtacctgggaccacaggggcctgccaccacaccctgctaattttttgtattttcagtagagatggggtttcaccatgttagccaggatggtctcgatctcctgacctcgtgatccgcccgcctcagcctcccaaagtgctaagattacaggcgtgagccactgcgcccggccaattttttatatttttagcagagacagggtttcaccatgttagccaggatggtctcgatctcctgatctcgtgatccgcccgccttgccctcccaaattgctgggattacaggcttgagccatggcaccgggcccgatttgtttctcttttatatgaatgtccaagctgctaagtaggacaaaaggataaagaagctctggtccataaagtcactaagagattttcatttcgttcttcttgttgctctgacatcctctacgatgtttttcttatcctcaaagtcaaaggtgactcagcatcatcatatctgttttaacccatgtagaaaaaaggagaaaaataagtagaggtcactcatcttccttttaagaaagtgacccaagagttgcacagaccacttctgttcacattgctttgaccagaatgtggttgccacacctaactgcaaggggtctggaaaaagtggcctttagctgtgtgcctagctacccagttttaaaatggagatttcttgtactaaaaaggaaaggaaggaaggaaggaaggaaggaaggaaggaaggaaggaaggaagggagggagggagggagggagggagggagagagggaggcaggcagggagggaaaaggaaaaaaaaaagaaaaaggagaaaagaaaagaaagaaaaagtgagtattagggacaattagcagtctgtgccacagtgtaccttctgaacacccaagtatccatgaataccactttcctccagaatacaatcaaaacagcaaagcagttactttttccagctcaaaacatagcatctaatatgccactggaggggtaagacacagatttcattcacaggtgtaccagagttgacttgcagcagcttgtaccagttcacaagaaacgtttgttaaaaagtttcaattttgtgatccagttgttaaacacaatcattactaaaaattaatttgtatataatgtatcattaaacaaattatattaaaaataaggtaaatattcaaaactcatcttttgaaaattattttactatgttttactattgccaggcagacctgtgctttgctttgttgaactttgcagatatgtttttcacaaattgaaggtttgtgacaatcctgtgttgaccaagtctgctagcaccatttctccaacagcttgtgctcactttatgtctctgtgtcacattttggcaattctcacagtatttcaaacttttcattattattatattcattatggtgatctgtaatcagtgatctttgatggtactattgtcattgtttaggggtgccatgaaccatgctcatataaaatagcgaacataattaataaatgtgcgtgtgttctgactgctccaccaactggccattcccctgtctctctccccgtccttggggcctccctactccctgagacccaacaatattgaaattaggccaattaataaccctacaatggcctctaaatttttaaatgaaagaaggagtcacatgtccctcacttaaaatcaaaagctaaaaatgattaagcttagtgaggaagtcatgtcaaaaactgagacaggctaaaagcgaggtctcttgtgtcagtcaagttgtgaatgcaaaagaaaaattcttgaaagaaattaaaagtgctactcctgtgaacatgcaaatgataggaagatacggagaaagttttagtggacagacaatcaaaccagccataacatttccataagtcaaagcctgattcagaacaaggttctaactcaaattctatgaaggctgagagaggaaaggaagctgcagaagaaaagtttgaagttggttggctcatggggtttaaggaaagaagctgtctccataacataaaagtgcaaggtgaagcagcaagtgatgatgtagaagctgaagcaagttatccagaagatccagctaagatcattgataaaagttaatacactaaacagtagattttcaatgtaggtaaaacagccttctattggagaaacatgtcatctaggactttcatagctagagaggagaaataaatgtctggcttcaaagcttcaaaggacagactgtattgttaggggtttaatgcagctgctgactttaagttgaagccaaagttcttttaccattccaacaatcccagggcccataagaattatgtaaaattgactctgcctgtgctctataaatggaacaacaaagtctggatgacaggacatctgtttacagctattttactgatatgtactaatattagtttactaattattagtttgctaattattttaagcccactattgagacctcctgcttaggaaaaaaaatatacctttcaaaatattactgctcgctgctcatagacaatccatctggtcacccaagagctctgatggagatgtacaagaagattaatgttgttttcacgcctgttaacacaacatccattctgcagcccatgaattgactttcaggtcttattatttaaaaaatatatttcagtaaggctatagctgccatacatagtaagtcctctgatagatctgggcaaagtaaatcaaaaactttctggaaaagatttaccattttagatgctattaaggacattcatgatttattggaggaggtcaaaacatcaacattgacagaagtttgagagaagttgattctaacccttatggatgactttgatgggctcatgacttcaattgaggaagcaactacagatgtggtggaaatagcaagagaactagatttataagtgaagcctgagaatgttactgaattgttgcaatctcatgataaaattttaacagatcatggttgcttcttatggatgagcaaaaagtgtggtttcttgagatggattctagtcctggtgaagatgctgtgagcattgttgaaataataacaaagtatttaaaacattacataaacttagttgatagagcagcagcagagtttgagaggattgactccaattttgaaagagttctgctgcaagtaaaatgttatcaaacagcaacatactacagagaaatctttcatgaaagggagagtcagtcaaagcaacaagctctattgttgtcttatttaaagaaattgccatagccactccagccttcagcagccaccaccctgatcagtcagtagctactggtagaggcaaaagcctctaccagcaaaaagattatgacctgctaaaggctcagatgatcgtaagcatttttagcaataaagtgttttaaattacagtacatgcattgttttttaaagacatggcaccattgaacactcactagactacaatgtagtgtaaacataacttttatgtgagctgggaaacaaacttatttgtatgactcactttattgtgataaccattttattgcagttgtctggaattgaacatgcaatatttttgagatatgcttgtatctaggctattgaggttatttgcatctatatcatctatatgatgggaatactatctaatgatgtggaaatctcttcccaactttgcattgtagcttgaaattacacatgatgggaatatttacaccacagagatcaacacttgctacaaattagctcccacttccccagctgaaaagctagttgttaaacatttaacagcacgccattgtttccattatatctctttgactagaatttacccacatggccgcacctatctgcaaaggaggctaggatatgtagactcaagctgagtggccatctaaaatttgggaattctgtcagcaggaagagagagagaatatatgttggcggatgattagcactcatattttaatgtagaagagcaagatccggataagtttctatacctgggatccactcttgtcactagttcgtctttctggggagggcaggtatctagtcagccatcttgaaccaaaattttgtcataggttcattagcagagattataataaactcaagatagagattttagtacctgtctagtccattatcacagggttagtgaaaattcaagatttcaatttatgatagtagattaatcccatgaagcaagcttttttgtcttatgcccagtttctagaaaatgtaaaaaataattataaatatataaataaatctataaacatgctggcaaacaggaaaatgagcccattgtaacccagaaactatgaagaatcactgaggggaagaaaggtgagataggattcaattacgtacctaaaacccaaaatgtgcctaggtgaatgcgagctttgaaaagtgggagccacacacagagagctccatacctggctctgctttcaggaagattcagatgaagacattggatatatacaagtataaaaggaagtccgtacttttgatttgctaaggaactggaatatgggggtacctagccccgggctcctccttccttccttagtgaagttcctataaaggttcatcttgttttaaacttttaagcctgtgagtattttcttttcaaacgatatagcaagctctacaatttagtgctcaatagaagctcctaggttagaagagatatgaccggtgactgaatgcaatgtttgtgtgtttgtttacaaagcaaacatccacacaagctgtttgctttttctacattaaagtataataaggatatttggaccacataatatggtcagagacttgtcttatgcatatatgacttatgttaaatgagcattatacccaaatattttatctttcaaaatcacgttagaactgagaacaaaaatccaggagtaaaactattaatattcccaggatgatggatgttgaagtacatacttcttcctcaccaaaaaaaaaaaaaaaaaaaggcgagtatctatttttagcagtattttccctcaggagatcagaaaagccattacagagttatggatgaattcttggttcaataataagaatgactaatgcttctacggatttaacagagctggaaaaggctcttcagataaacaacattttagaatgttggaaatttgcattttggaaggaaggaaaatgaaattataattttatttttaaatgatttatctgtttctcatttttggatcattagacacatatcttgaaataatagtaattcagcacttactataagtaaagtgccactaagccctaaaataaacacaatgatgccctcaaggggcttgcaatttagagagaaataagaaaaagatatcttagctcaactttttaaaaaaatgttgaggccaagtacatattgactgtttcatctttaaagcaggttctgtctttctcaacaagttgggaatgcccatgctgtgagatttgtaatattaggtaagatatctgtaattcctcaatttattcactagttagaatatagcctgtgtatcttagtttagagaggaatataaatcctttataacaagtccacctttaccctaaaggggatgaattaggagaagaggaagagaggacaggactgagctgataaattttcacaagtgccttgaaagtctgtttttagctataacgataattgattttagtaatgtgtacacattcccagcattttgccctttttcaccttttgagaatccttggttgttggattactgatgctaggttattaagtgaagagaattagagaaagtgaaaacactaagttgatttacatatgaaagggtatagagttactcccagaatagaaaaatctagaaaggctggagatctatgtgagagagtcatctgggagattaatgagagaaaggagaaagattgagagatgctaccataaatgaatgggcagagtgatacctaaaagcgtaatttctagaagctttgctccctgttgaagtatagatcttctttactgctctgtgaaagactttaggatattctgtaattccttggtatctgagagggattgattggttgtgttactggaaagaggtcccaatccagacttcaggagagggttttggatcttatgcaagaaagaattcagggtgagtccacagagtaaagtgaaagaaagtttactaagaaagtaaaggaaggctgagcgcaatggctcacacctgtaatcccagcactttgggaggccaaggcaggcagatcacttgaggtcaggagttcaagaccagcctggccaacatggtgaaaccccgtcactactaaaaatacaaaaattagccgggcttggtggcatgcacgcctgtaatcccagctacttgggaggctgaggcatgagaatcgcttgaacccaggaggcggaggctgcagtgagccgagatcatgccactggactgcaacctgggcaacagaacaagactccatcaaaaacaaaaagaaaaaaagaaagaaaataaagggataaaagaatggctagtccatagatggagcagggcgttcccaaaagcaagaggaggaaaatgcccacgttaggtacaatgcttgattatatataagataaagcaaaaaatcatgggggagatgtgctgtactacaagggcttgtaacaaaggtttgttaatgtttatgtaaatactgtcttctgcaagaatatatattattatctttaaagttaaacttaaactaagaatgcttttgtttttaagatatcaggacatcagaacatttcctgggtctgatatttcctaggtctattaaatcctggctctattcagtaaacaatattaacttttttccttaactgtaaacatcctgtgactaagaatgcctaacctcctgggaatgcagcccagcaggtctcaacctcattttacccggcctctattcaagatgggctcctctggttcaaacacctctgacgtatttccccccttccttttacaaggggacccttcattctaaggagctttttttcaggctgaatagaggcaatgatattcctgccttaactattaggatctcttgtattcatggtagagaggaattcagtcagaaagtatcagtatggtgagggccatttatataactctgggtcccaacaaaaagtgatatttatttctcttgtttcttcggagtagcagccagagatcactggttggttcacaggaataagcagggtcagtctaaattccagaaaaaactcaaatacaatggatctaaaaacaagtgttccatagttatttaaaaatatattctttttctctccagtcccaatttttattaaaaacaaatcatggtaagattgatttgtttgcaaaataagctttagtattattatattcagcctgattatttgcataaagtgcaacaagaatgattatttgccatgtaggctctttttaaaaattggctttattggaatctcaggttaaactttttaaagccttgagcccagccatgggtttatctgttcctgaacatacctgtacaagttgggtgaattcctctcctttcaaagtcccaagataacttgggcctcctgggcctgtcagggacctgtacagggactgtgtagaaaaggtatgatgccagttttcccaaggggcttttatcagcctatgagtcaaatttgattccttaaagcagtctatttatatctgaaagcacaccattccagtcaaagccttggtaaaataacaagtgtctccaattgtgtcctgttataaaagaaaacagattcttattgcaattcttatgcaaataactatattgccataaattaacaatgctcacagatagtttctaaattctggagaaatttggtagagagaaagaaatatgctccaaattttgtttatagaagtgtgctttactcaattgttaaaagctgtaaatagctcaaaagaaaagtctccttgattctgaaatgaaccagaaagtttgtcaaatatcaaaggtttaaaacacttgatattataaaatagaatctcaggtcaccataagtcatttattagccaaaatgataaagattttaaaaacgcaaaaacctttacttactgataaagggaagacttagctttccaaacaatctttctttttttctctcttcttttaacaacaatttttcattatctcttaatattacatgaaaatcttgttcaagagagaaagccaaatttcaactttgtattagtgtactattaatgtcaaacctaattcttaataaaaccttatagacaaatctatccaatcttaatctgtttgacaataaggtaatattttcagaaaactttcataaccctttacaatgttctgcaaaaaagcacatcagtgtgctaagaaaaccctgctgtgcttttattccaatgttcaagttatggggaaactaaataatatccctttagctttagccaatatgttcacacacagaatttcttttacaagattaacctttcaaaaacgttccacaacatactcaaacctttggctttttcctatttaaattaaaacaatcctttaaccctctaagctaggcaaaaatcatgctcccgtgccttcttatactcttttaccaaaaacacattctactttccttataaacattgcacatgaaactgtttcaccagtagtctcaattacatatgttacaatgttaacttttagcaacttttatttttggtaaaaaaaaaatcctggtaagtaggtgattttaattatgtatcaagtgtggagcttaggacaccagacagaagtgcagataaggtttgattctttccagcatagcaagggggcatggctaactctacatgtcccaaggccttacctagaatctaatggctctaaagcaggtaagttgaacaattatcaaaagtcaaagaaccagactgtgtagtttagtaaacacagtatccgagcggcctaatttagattttcaaaacatttttatgttaccaataatctttaaaattatctttatttcccaaagattactaaagccatgtgaactaaaaggcattaaagtttcttttttctggaaagatatttaaatgcttattacttttaagccaattaatcagagctttcatttattttggtagcaagatatcagacacatacaacacataaatacacagatggacaggcagggcagatttgatagttaaagatttttcatttgctagattttaagtttttctttcacatttttatgccaaattctgggtcattaaaaagagggaaatgctataggaccagacagtgcaatgcttttaccacaaattttactgcaaggacatttccctgaagctgatgggcaatccaaaaccaatcagcccatctcctgtgagagttttaaattttgagggagggggtggtggtggacattttcatattttgcaggtggctaaaaccatgcttctctgattcaaacatgcaagtagtggactatttctcccccataactgccattagccatccccaaaagtgtatttcttatctagttattacaagccaaggttaaaagctctttaataatgcaaagtaatttttgatatccccaaaagtcaaaaagtcaggtaatgcagtgcaaaatggaggacagccttagatttttacagggatctattcacttacaattcctggggctttatgaggaaaacagaggtttctctcaaaaaagggtctgtggtgccttatctgtatttttccaaggagtgccaggctgtcaaaaatcattttaggccctttcatttgggcattgagggcaagaaaacagactggggaaataattcagtcaattgatgagaacaaaacaaaaaacattttatcaaacaaacaagacccaagaagagaaaaagcataaaggtcttttaagtaagtttacagataggtcgtatgcttttaattaagctgatttttagccaaatctcttttaacagactctagccaggacaaacagccaatatttctgggttttgaattttaccaaaggtaacctcccaggtgaaaccagtaagccttaactaagggtatgacttaaccatgaacacacaaggtgtcttcaaagaaatggcaagcagttttacaagttttagagtatccaaagtatcagagaaaagaaaatttgagacaggaagtcagaagttgttcatggaggggtaaataatcagtaaatggcaaaggtcacacaaacataaaaccagaagggactcattacctaagctgggaattgaacatgagctaccattgtaaagagataaagccttagctactgggctatagcatggagcagtctcaggtgctcttcccagaaggagcctagagcagccaattttgagttttcaaatgcttttaactactcatgataatttttagggctaactatgacatgaacctcaaaattcccacaccccagatggtggataccaagagaaagtacccccaaatggtcacaaggttaagctcccaaggacataaaacaagacaaggggtaaacctcatctagttcttgcttcaggtatctgtagcaaactttatacctgaccagtttgttaagccagcttgaatagtgggcttaaaggggtcctaggcccacattttattctatggtacccctttttatgacagaatgacacagaaaggcaaattcatagcacaaaatacactcgattcactatagcctaagactagcctcacaaatcctttttccagttaatcaaaaccttgcagaggagacaaatagtgatttttaccgtttattcaactggtttacacagaaagagagagaccagaatcctgactgctaagaaattcttactcttttgctggcatgccaggtttctggacttcctttctctgggtggtttgatggccctgcttactgtgccatagctttgtgggccaagacacattacaaaagaaaatcatgtttttccaactttgcaagatgctgcccaatgagctgcatgtgggagccaaattaacattttgcactctggctggggcaaagtacatgtgacaaaacatagactttagccatcccactcagcacctaatatcaacctggcatggctcaaatttgccctcattggcccttgttgtctttgatccactcaaagtggggtggaatgttgaaaccaggagtttcaacacagggtctctaggcaagatggaagaacagacagtcgccctgagtgatagaaaagataggaaagggaaaagagagaaagataacaagaaaaacattgcttacagcagagtgggggaaagtgaggagctcagggaaaccagaaaaagactcacccattgcggcgacactgaatcaaaagttcaggcggttgcttgtcagtcacgaagggatctttagcatcaatcctattagctctcaagtttcccactttgggggagaaagaaaagttccccatgtcccataattttgcacgtgcctaatcctgtcacccacaaccatgagataccaaatttcaatagacaatcttagggattgagctttaaaatgaaactaaattcttcagtgcctttttgtccccagtgtttctcagctttgtgacggagccaacaagcaaacagatggaaatcaggtggtgcatggggtaagggaaagttaaaattcccagaaccaattaagcgaggtctcctgaaagtggcagtgagccaccgcaccaggccacactggagtagattttgaagtctgaaacctagaacttgtcaaataaaccgccctaataaaaacacccctgtcaacaaagggcagttctaaggcttgaagtcagatctgaccctcgaagttgacactccagcctctttgactctcaggtctttgaaagaaaagggaaaggtccatcatgactttattccagagtgaatttctttagttttcagaagccactttaccataaatagatgtgccttgggggccgggcacagtggctcacgcttgtaatcccagcactttgggaggccgaggcgggcagatcacgaggtcaggaaatcgagaccatcctggctaacacgaagaaaccccatctctactaaaaatacaaaaaattagccgggtgtggtggcgggcgtctgtagtcccagctacttgggaggctgaggcaagagaacggcgtgaacccgggaggcggagcttgcagtgagccgagatagcgccactgcactccagcctgggtgacagagcgagactccatctcaaaataaataaataaaataaaataattagccaggcgaggtggcgggcacctgtagtcccagctactcgggaggctgaggcaggagaatggcgtgaacccgggaggcgcagcttgcggtgagccgagattgcgccactgcactccagcctgggcaacagagtgagactctgtctcaaaaaaaaaaaaaaaaaagatatgacttgggaagtgaaattctctaatctgaaactttattgcaaaaattgtgggcatctaggagaactggagttgtgagcaggtcagaagagaaactttgctgcttcctttgtcaatgctgtatggagagaaatttgagatgctttggatattaaaagaaagactggaaggcagaagatactgaattaaccacaccaatgaagagcggtaagcagaccatgcgagtagcaagactatttctgcagagttcataacaggagctgtaagtgacccagagaatactcactgtggaaagttgagatatcattaggctctatgagacttcaggttgtagcattttacttgttgcaaattatgtagtggaattatacttctttatcataaaaatctcttgcgtcgtggtgtggccagggctctttcatatatgggagttggtatcagtctactaaacagtccagtggagacagctctttttgtttcctattgaagtctcatactaaaaaataaaagctgactattttactacaaatatcattaatcctaaagatagttttagatggtacacaggttttaatgtttttacaataaggtcatatgaagccaaaataactcctggatgtgggatgggcttgagtgggggggataatcatacaaagagtttttattagatacattgaaaagcaaagtaaaatttacctaataatagcccacccagtggaaaataattgctttaacttctcttggatattttaatctcaattctgacaaaatgaaggcctcttggcaatttaacagttctttggcttttagctgaaagaaaataaaaaaaaaaaggaagtgccactaatgcttgagataaatactaagtcttacaggactggagttaagttgttttccaaacagataaaaacatatcacaattatgcttcatttaggttttattccctgcattattttatcttcattgtgtcatactaatgtggcagaccaggactcactaacacaggcctccataacaactgtttcagcactgactgagtggtaaagttaaatattaaaagctgatagagccagtgcccttatacaaaggctggaaggtaacaaaagcccaccaagagttttgcccaggcctttcctgggccctgaagcatggcaagataacgaaggaattcttaacaggacctttttaggattaaaaaattttattgggggtctgaagaaactccccaggcctccacaagcaagctttattggggactaaaggaactccccaaacctccatgacctaccaggagacaagataaaggtaatcactccagcaccaggacccatttagattaagtacatttactgaggcttcagaggaaggtcttcaggactcagatcttagttatagattaaaagaagttaatcacttctgtctttagatgaatgcacacttacatctagacatatagcttagaaggtatataagctctgaaaaacattgtaattttggattggtctggcaataatatccaggccttctccctgtaactggttacagaaataaaaactcccttctctcctagttcatctgcatctcattattgggccgcaaggatcagcagcccgacccttggtttggtccgggaacactaatacctaatattcccaaatgtatgttggccttgccactgtgaaggaaaattaaatgggagtcacatgtcctcttatgttttgcatttgtgttttgctctgcgtaaaaatcatgcaaacacactccagttgaaaatggatacagaatcgaaatagacatttctctgaaaaagacatataaatggccaataagcacacgaaaagatgctcaacataaccaattattaggaaaatgcaaatcaacgtaacagctgagagaccaacctactaggatggctataataataattttaaaaaacaggctaggtgtggtggcctatatctgtaatcccagtactttgggaggccaagacaggaggatcacttgaaaccaggaattcaagaccagctgggcaacaaagcaagacctgtctctacaaaataataaaataaaaatgtaaaaagtagataataatgaatgttgatgaggaggtggagaaatgggagccttatagtttaaacatagagtaccatatgatccatcaatttcactcctcagtatatatccaagaaaaatgaaaacaaatgtccacacaaaagctgatacatgaatgttcataggagcattattcaaaatagtcaaaaagtggaaacaaccaaaatgtccatcaattcattaatgtataaataaaatgtgcaatgtccatacaatgaaatattactcaacaaaataaacgaactaagtatggatacatgctacagcatatatgaaccttgacagcatgctaagtgaaggaagccaatgacaaaagatcacacattgttgattcgatatatgtaaaatgtccagaataggcaactcggtagaggtagaaagtagattagtgcttgcctaaggctggaggattggaaaaatgagaggtaactgctgatagttacagggtttctttctggggtgatgaaaatattgtaaaattgattgtggtgatggctgtacaactctgtgaatatactactattgaattgtacactttaaatgggtgaattgcgtgttatgtaaattatatctcaataaagctgatatacacacatacatacgtgtgtgtgtgtatgtgtgtatgtgagtatgaattatccaaaggatttcatatgagtgtttgtgttttcaggcaaatatcataggtatacttataaagaaacaaacatggttctctttatcttctgtaggcctcttggcaatgctttgcaactctctttttacaataaccttacattctctgggcatctctgatagatgtatggaaaagcaaatctgggagcaaggaattcttagggaaaaaagcttgcatcctacttctgccccaaattgttcatctccttggaaaactagatgtggatgaaatatgtaaagcaacttattctgtggtttaattcaaaaactatattgaagttccttagttggctttgcactgaggcaggaactctgggaaaacaaagacacgtgaaacagagagattactgggtaatgggataacagtgcatgaataaataggtcaactactaacctgagagataaatgtaatacaagccataggtatacctgggataaagaaggcttttaagtagagcagtaaataataggctgccttctggctagatagataacagtaaaggggcataattttatccagtgaatgtaaagcacacgacattggagccaaacacatattaaagcaacttctcagaaaattgatttctagtatatgtcaaaggttttatttatttatttatatataatatatataatacttcaagaaagttaagaataatcctattcaagaaagattctttaccttcatttgctataagtttgaataacacctttgacatatactacatatgtgtatatgtgtatatacatatatatgtatatagtatagtatgttatatatacatatatagtatatgtatatatgtatgttatatatacatatattgtatatacgtatatataccaatattagtatgtatgtatataattgtatatacatatatacatatattagtatatatgtatatattagtatatatacatatattagtatatatgtatatattagtatatatacatatattagtatatatgtatatattagtatatatacgtatattagtatatatgtatataattgtatatacagatatacatatattgtgtatatacatatatacaatatatgtatgtataatatatacacatatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacaatctatactatatatgtatatataacataccacaatctatatatgtatatataacataccacactatatactatatatgtatatataacatactacactatatactatatagtatatataacatactacactatatagtatatataagtttgaataaaacctttgacatatactatatatagtatatatcatctatatataatacatagattgtatatataatctatatataatatatagttagtatatataatctatagataatctatagattgtatatataatctataatctatctatagataatatataatctatagattatagattatatatacaatctatatataatctatatattatctatagattatatatacaatctatatataatctatatatataattatatataattatatataaaatctatatatataatctatagataaactatagattatatataatctatagataaactatagattatatataatctatagataaactatagattatatataatctatagataaactatagattatatagagattagtatatataatctatatattatatagagattagtatatataatatataattaagtatgttaatcttaattgcttgataaatttttaaacctatgtaaccacaattcacaattcaggttatggtagagaacattcccatctccccaagttgctcccttgtgccacttcccaatcagtactactttatcttacccaggtaaccatttacaagttttgccttttcttgaacttcatataaatgatattacactatatgtcctcttttgtgcctagtcttctcttgccctacaaaaaaatgtctgtgagcatcacccatgcttttgcatgtagcagtagttcattcctttcaattactgtgtacgtatatttatgactatatcacagtttacttgtctatttacctgttgttggacattagagttgcttccagtgtttggctattataattaaagcatctgtgatccttattgtttaaagcttttggcagaacatgcactaatttcttttgggtatatactcaggagtagaattgttgggtcattgagtttgtataaattagcatttggaaatactgccaaacagttttccaaaggagtggaagtgtacatatttacactccaccaagcaatgcattggagtgccagtagaatatattttttaaataagatgagagtatggctagatactactgttaaactggataatagaaagaaggtctggttctggaatccaaaccaaaaaatgactgggtgagtcgttaatgcattgtgagcatagatttaacttcccagacaggtcttctgatggctgattttatgtgtctatttcactggtctaagggataaccagacaattggtaaaactttatttctgcaagtgtatgtgagttttctggaagagattagcaatttgaattggtagactgagtagggaagcttgctctcaccaatgtgggtgggcatcagcaaatacattgaaggcctgaatagaacaaaaaggtggaggaagggtgaatttcctccctgtttgagcctgagacatgcattcatcttctcttgcccgattagtgacactcctgcttgtgtctgcatcactactccctctttactgaccccatccccacttgttttcagtcctttggattctgactgagttataccaccagctttcctggtgctccagcttgcaaagggcagatcatgagacttctcagcctctataattgcgtgagccaattcctgtaataaatcaatctctctctctttacctatgtctatgtctacatctatgtctatcacctttgactctgtttctctggagaatcccgacagagctgtaaatctaaacatctattagaaaaacgctcaaacatttttatcagaaatgcaaaatacttccaggagtggttgttaattacatcctcaaaaagccctgctcaaagacttaagttcaaagctagatataccatttaataattgtatgatctttggtaaattacttaacttctttgtgcctttctttccttagctgtaagctggggacaataatatctacctcataggattagtctagggttttagtgtctggcacagagtaagtgttcgattagtttttcttttccttccttccttccttccttccttccttccttccttccttccttccctccctccctccctccctctctctctctttttttctttctttctttctttttcttttcttttctttctctctcctctctccttccttccttccttcttctgaggtcaagtgtaaattgcaaaagagtaatgccattttgaactcttaaaattatcttaacaaacaaaattatagggcaacattgagaaaagtgggatggtggaggatggttagggaaaagaaaagaaaaaaacgtaggaaggcaagacattatgtccccatccttaaaataatgttctctctcggaggtggttaagtaatgtgcagaatagaacacctgatattctaaaaattaaacttcattgtctatatcaatattaagcacattagaaaatagactgattcagctttaatgatatattacaagtggatttgcattgaattgaagctaggtccatgtgaaagtgtatcaaaattaaaatctcatttgcatatatagcatcagttagtacaaatgttttttgcatgattatgctccctctaggagaggccattaggttgatttgcattcatttaaatgttcatgtgggatgttgattttgtctgtgcaattactagggtagttaatacattgttctattaaaacagctaaaagactgcacagatgctgtaacatacaaatgtagcaattgatgggttgattggaaggaaaccttctcacataaacagtcatcttttcttcagtgtgagcaaaataactgaaactgattcttctacacaaatccctctcaaccagtgttattcttgtgtcctggattcacaaatgaatggagagtctttttttcaatatgcaaaataaataagtaaattacatggtatgctagaaggtgtggtagcttgcaaatatggccacaaattcttcttatccctctttgcacatctgtttatcatgtttccttgcagcatgtctttgcagctcttctcaccaagaattggagtctattttctcaactcattaaatctgagctggctgtgtgacttgctttggccaaaaagactttagcaaataagatataagcacaagcagaggtttgaaaagtgctggttcgctggggcttactgtattactgctcttgaaatgctgagatgaccatgtgaatgaatccaaggaagcctcctggaagatgagaatgctgcatagaagaaaacagaggtctccagctgacagcctgccaaacactagaaatgtgaatgaggccattctggatcatcttgtcaccagctgacctcccagctgactatcagtgcatgagcaaacccagaaaagatgagctgagccagtccagtgtagaagaattgcccagccaacccacagaataatgagctgaataaaatgttgttttaagccattaagtttgtgatgttttattactcagtaatagctaactggtactgaatgttataattactgcagagaaaaatagagcacagagggaggaagtagaagtgtatatgtgtatgcatgtgtgtagaggaggggctgttgaaattttaaataactttgtcagggaaggccttgttgagaagatacatttgaacaaacatttgaaggagatttaagtaattcatgtggttatttaagagaagaacatggtaggcaaaaggaatggcaagtggaaatttcctgagccatagcatgtctggctctttttgaaggaaagcaaagaagtcagagtgctggagcactataaaagatgagggcagagggccgggtgcggtggctcatgtccataatcccagcactttgtgaggccgaggtgggcagatcacaaggtcaggagttcgagaccagcctggccaatatggcgaaaccccatctctactaaaaatacaaaaattatccgggcgtggtgtcagacacctgtagtcccagctatttggaaggctgaggcagaagaatcacttgaatccgggaagcagaggttgcagtgagccgagatcatgccactgcactccagcctggacaacagagccagactccatctcaaaaaaaaaaaaaaatgagggcagagggcagagagttaacaaggggccaaatacatgtctcatgtgagagtatgacaattaatcaacatggaagtaaaaaactgacatgagctgaaccgatcagtttctccctcctgaaactgtgaaacttgagacacagagccccagagactgggagatgttggagctgaagtcaccttactggctgtcatagcctgctcagtctgctacaccataagtactataaactgggtagcttataaacaacaggaatttattgttcacagttctggaggctgcaaagtcaaggtgctgccaaatttggtgtctggaggccgggcacggtggctcacgcctgtaatcctaacactttgggaggccaagacaggcagattgcctgagctcaggagtttgagaccagcctgggcaagatggtgaaaccccatctccactaaaatacaaaaaatcaactgtgtgtggaggtgggtacccgtaatctcagctactcaggaggctgaggcaagagaattgcttgaacccgggaggcggaggttgcagtgagccaagatcacgcgccactgcactgcagcctggacaacaaagtgaaactctgtctcaaaaaaaaaaatctggtctctggcaagggccttcttcctcagagatagtgccttcaagttgtgtcctcacgtgggggaaggggcaaggcaactctctagggtctcttttgtaaggtactgatcccattcaagagggctccaccctcatagcctaatcacctcccaattgccccacctcctaatactatcacatggggtattaggtttcaacatatgaatgtggggggacacaaacattcagactttagcactgcctgaactcagggggccatagaattcatactttgttctagttgccaaatttcaggagctgacttgcttcttgtccttgtcaaggttcgatggttgaacttgttttttgagtctgtggaaccctcctgaatcattaaaatgaatttgttccagcactcaatctttttttcttaaataaagcaaagttaatttctgttgcttgcaaataaaaacgcttaactaatataattatcttgtgatttctctctagttctttaatatagtccttttcttctgaaatagattattagtttcttagagacaggaataattctttccatttattttatatccttcctctatgcagctatacttataggacaagataataacagctaggcattcattcaatgattataatgtgtcaagcactgtgctaagtacttatgtagattatcttatttaaacttcatgagaattctgtgaataattactctgattatttctcttttttatagatgaggaatcagaaaccagagatgggacatggctaataaatagtggagtggagactcaatcctgggcaatctcacctaagagcccacattctttcaggacccagcacttagtaggtacttaaaaatacttgtgtatcgatatattgaaaagtactaagtatccacaaaatcacattcattaaaactttggtttgcagtaagaatacttgagacaacgtagaattttgaataagaatcttataacataccaaggaagaaaatataagaagtattatttgtagaaaaattcaattattcccagtaataaagaaaaagcattaatctattatacatcatttattattattaatctttattattattgttattttagagacgggccttattaggtcgcccagggtacagtgcagtggcgcaatcatagctcattgcagccctgaactcctcagctcaagcatcctcctgcctcagcctcctgattagctgagctaatgaggctcaggcttgagctaccatgcccagcctacataaatctttgatatttcttctaacagccctaaaagataaggtaggtattatcatgctcacttaactgattaggaaacttaggctcagaaatttaagtgctttgttccaatctgttaacacccaaccctaaaggtgctagattcagtgagctgaaaatgctcactgaaaacgcaaaatgcaaaatgcctaatccttagaaccagacactccagtcaccatttatttgtccatgtctgagttcacaacacatcctctctccctatttcatttgccatttaattatgtgctgccccatgacactggtgtgctacttcataattatgatcgtgttattttagtgccatgcagcttcattgtaattttacttgtgagacctttttttaatatattgggtacctataagaatgaaatatttccataacaaaacagatttacagtcagcttgtaatggtttaatgccaagatgttatagaactatctaccaatgaagaaagggttgaattgaatcagataatgattatatgggcttttcaaatttaaaaaaaacaagcaacacttcagagagaatttatataatttgcaaatataggtaaatatgtaagcaaatcttcattatatcatattcagtatttgttctcttaagcataagagttgtgcttgtccgtatagaataggctgaatgaaactgaaacaagtcttgctttctataagttaatatttggggattggtcacacacaaagacacacacacacacacacacacacaatggtgagggaggggcttacctcttttatttactgtcccattcataatgcctagaacagtgcctggtgcacagtaggcaaatatgcactcaaatatttccttagtgcctaccacaggccagatagtgttctaggcattggggatacagcattgaataaaacagaattcatactttcatagtttatattctacaaatgggagacagaaaataaagacataaatgaatatgatatttagtatgtcagatagtgataaggacaattggaaaaattaagcaggaataagggataaggtgggagagttgccattcaaaataaagtagtaaaagaagacctcagtaatacatgacttttgaaggaggcagtcaggaaacatttcaccagaagatgacaattaaactgagtcttgaaaaacaactaggagttttccaggaagacaagaagggagaaatatatagaagatgaataattcactttgaattctaatttgcatctccttttacatgtagtggcatcatttttaaggcagatggtgtataactttgctccagagttaagaattctctttcctgaaagctccagggataattctgattggttctgcttggatcatgtgtccatctctgaaacaattaccatggccaggcaggtagtgtattcttattggctggcctgggtcatgtgcccactcctgggattttgtttttttgtgtgtggagggggcttcagagcccctactctgtgtaatcttccccaggagatcatcagttaggggaggcaaagaaagtaacttttctctttttgatctatcagggtttgcaagttcctttgaaagaagagaattacagaagtattgagactggaaggagcacttagtgcaggaccacaggatgactgactcctcagcacagcttagcatcctggtgccaaagtgggtgcttcacaaagatttattgtataaatagagaggactatcacaaaccacatgttgactgaatgactccaccattgtctaaccactgattttgaggggatcccttgggactatcccatagatccaagttcaccttaccttgggagcagatggaaccagaccccaggtgctctgccatgaatctccctcaggtgatccgggcatcccaaagatcttacctcatagaagctgttgtagaagcaattgcaggaagaggcattgatgcagcgttgtcattaagcaaaaagccaggactgctgacactaccctgccagcagacaagcctgcagctgggcctgaggctctcacaggatgcaaggcaagcacaggattcatatgagggacaactatctaaccggaaaacacaaaacctccattaagccttcgctctgcagcttttctcagagatccttcctgtctctcctctacactcccaaactgaagttcttctctaagaagtaggcccatattattcaatcataagaaggaatgaagttctgatgcatgctacaacatggatgaccttgaaaacattatgctcagtgaaagaagccacacacaaaggcccacatattttataattccatttgtgtaaaatgtctagaataggcaacaaatgaaagagttgagtattgtgtaagggaagtttgagattcctattgccattcaggtgaggatgttgagcaggttgctcaacaggttgcttgataagtgtctggagttcaggagaaataaccagtccagaggcataaatttgggagtcattagcaaataattggaattttaaagcatgagactagattagactacatgggcctgataaatatttgataggtaataaacaaatatacacaatatcttctgctataacacattatctataacaaatagtatatatgtaataggaaataggggaagaatgtcaataccatgtggacgttgggttgaagtagaattttaaccttcagcatgaaaggaaaaatccctcaatttggctgctgcagtgtcaaaagcccttttagctttatttatgttttaaaattaaaagtgaggttctacacccagggcttcctctccaaggaagtagaccctcagccttgcatgattcttgcctcaggcagagtgtacttcttcctgtgcgcaccttaatagcagcctttctgtcttagacttccacttccatctgcattgtctcagctctctcaagtagaatttcctctctattggtttcttgcatgtttaatatctactgaggtggcctctagccataacaagctgtgtgtctgagctgtgcacaagtcatcacctgatatattattttaaaaaaattgttaatgctctgcttataaaggtacataagttttgagtgatctgccttaactcttatgccttgttagttttagtgtgtgattttgaaaaatgagagatttttcagccgagtatgtcattttatgtcagaaatgcttgtatacatataattgacatgctacttttgttcacatctttcctggcaggaactgaaaggtatttatatttatgtttctctccctccgccaaaataaaacaaaacaaaacaaagaacaaaaacccaggaatgggcacatgacccaggccagccaatcagaatatactacctacctggccatggtaattgtttcagggatggacacatgatccaagtagaaccaagaattgtccctggagttatcaggaaagagaactcttttaactctggaacaatgttacacaccatctgccttaataatgatgccattacaagggaaaggagactcaaattaaaattcatttatgcagccaaaaaacacacgaaaaaatgctcaccatcactggccatcagagaaatgcaaatcaaaaccacaatgatacaccatctcacatcagttagaatggcaatcattaaaaagtcaggaaacaacaggtgctggagaggatgtggagaaataggaacacttttacactgttggtgggactggaaactagttcaaccattgtggaagtcagtgtggcgattcctcagggatctagaactagaaataccattcgaccccgccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaagggcaaaaaaccaaacactgcatgttctcactcataggtgggaattgaacaatgagaacacatggacacaggaaggggaacatcacacactggggcctgttgtggggtggggggaggggggagggatagcattaggagatatacctaatgttaaatgacgagttaatgggtgcagcacaccaacatggcacatgtatacatatgtaacaaacctgcacgttgtgcacatgtaccctaaaacttaaagtataataaaaaataaataaaaataataaaattcaaagtaaattactcatcttgtatatatttctcccttcttgtcttcctggaaaactcctaattgtttttcaagactcagttcaattgccgtcttctggtaaaatgtttcctgaccacctcctgcctcctccatgaagtactgtgagcttccttcttattcccacagcacctttgtacacatttctcttacagcattgttatgtaactttgctttattatctgctcttccccttcccccacccctcagtctgtggcattcttgatggtagtcacattaccttatccatttctataaacctaggacctaacacaatgtctagtatgcattaggtgcacagtaaatgtgagttgaatgaattaatgaagatatggctctggtaatatatggctgattgctttgcgcaagaagacacattgtcttggaggcacacacgcacacacacacacactcactctctggggaatgtaagatttttgataggtaagaattttgatccaatcttaaaacaaacaaaaaagaggtgtgtgtggggtggtccgggggggggggtgatatttcctgcaaggtagggttcgaggaaaggcacttcattaaaattaaacttgaaaatagggcattgggagagaatgcagagtgggggggactttagaaaaagagaacaaataaaattggaaatgaaacactgccttataaaattagaaaatagaggtagaaaaactgaaggctggtattattcagggaagtaggtatagacaagcaagaaaagtaaaggtaaagaaatggaaaaagatggaaagtagaggtgggagccagagacagggggaggaaggtcctggatagtagacttctgagctttcaataaagctttattttccactatgtgttaggccatgtgctgggttattagtacattgaaatgagtaacttatattccctacgcatccaattatgggggagatctcagtttataatggtataagaaagcaatgggatgacaacaaagggcgagtgttaggggatattgcccactttttgaaattggacccccatcctttaccagagttgtaagaagtctgacagctgaaatgctgtcctcaagttgagaaaatggcccaccccttccctattcttgtttctttctctctgaactctataatccctcacccttgccagggctaaaggaactctttttatacattttcttccttccagttttgatatggtgaaggcaggactgagggctcatcacccctacccctcctcctagcagaacaagttgacctttaccagaacacaccaggtcatgagtcagaattcccatgccatgtttgctgaagctattaactcttctaagtcctggcaccccaggacatcttgaccgtcccaacgaagcactgccaccaaaaccagtttgggtggagccttggcttttcttactccatgtcaaattaggaaggtgacccctggcaccagggtcccatcattccccacagtacttttccaagacccaggggggatatgagagaggagagacttgcagcctcctccacaaggaagggggctcctaggagatgagatgggagtaacttgtgccttggctgtggtgagcagtaggggtactcctggtgtaggtacaaactgtgggaggtttgggcatagccatatccaccttgcaggtggatgtgtcagatgggccatggtgtgtgtgtgtggggggggcgtggggggtgacagttcctgcaaggtagggtccgaggaaaggaaagacctatggaaaaggatacacctgggatcttgaggagccagctgcacctgtttctgggctgagaggcttccggagccaccacaaggtggagaccaaggatggcgggggtggggtctttgcagaccggttgttaagtcctggggctggctgtgcatcctgaagcccgtttggcacagcctgcaggagggactttgcaaagccgcgtccaggtagtatatgaaaggtgtgttgagctcaaatggtcagcccggggtcatggggtcctggggtggcggggagccgagaagagggagatccacgaaggaggctttcaccccttggcagcgggcggctgccttgaggggcgggctgtgcctggcgcgactctggcgccgccgcctgggggcatccggctgtgagccccgtggatggggcgcctggagaccgcgtctctcgaggcactaggtcctggtacttgctgggggtggggagggagaggggcgcacagcgccgagaggcggacgccaagcgcgtgagtcactctgctcccctgggttaggagcgggactttgcctcccgcctggggtctgcatttcagctccagcttcagtgactcatcccagcaggctgaccccctcctgaggctggaccagctgcctctccgtctaggtgagggccaggcaagtttctcgtcttctgatgcttactgtttgggggactcgcggggagggggtcttccagcctgtgtctgtctgcctttgcttcctccctctggctctctccattggagacagaaagttagatttaaaaaacgcaacagagaatataaaatctatgctcagaccccagataaacaaaactctggggccatattcttaatttaccgggtaccttcacatgtccgaatgcggcgtttatggagctaggaatgttttatttgtttcgtgtatttccctcctctcccccattttcctccggtgtaattcttagaggtggggacaggagagccagagggcttagctgggatcctttgccagagtggcttcttcattctctgcgaggtagcagatgttttactgtagcctgagttgggatcttggaacaaccctctccagcccaggacatgccagcgcttaaggtaactgcagttgttgcatatctatctcgttatcactgactgaatcgaaatgttccggaggcacaattaatgtgaatgccagaatgttgaaacaattcattgaaggacactattgaatgttttattttcaaagtatcgtattccaggaaaattttagaagactattgctggttttattttctctattttcagatatgctccaaagcctattattcccttgcaagacaaccagtgaggacctattctgtttcttataaggatttaacagtgcaaaactacgtgttagtttctcctctaaggttagggacctccttctgttaacctcttttagaaaaatcattttggtggtggtggcggggagatgtttcccctttctctatcattaaatgcaaaatgtttctgtgactattaagtaaatactaattattgttatttttgcttaaaaggagcagaggagagcatctcccagaatgcatgaatttgtggttcatattgataactgattgctttaccatcaaattgtttggtttgatgcaatgttaacaagtggtcttaattcacaacacagaagtattctattccagaaaacaaccctgctgatatgcctgccacccccaccccaaaatgcacacacaaaaccatgtttttgtcttgctttgtgggagagaaaaatggatggggtatcttttctggcagttgattagtccccgatctttcttgaattgtcatttgttttataacctataattatagaaaagaaccctccttgaaataaaattaataaaaccttacatgtttagtcagatcacaggaataattttttagagttgagtggaagcttccatgatcctcttccaatgtcgtccccggggagccgttaagcttcccacttctctgataacataactcctctactctacatacctctatcttagctcttaccaccttatgattctaggtttacatatccatcttgcttagagtaataaaatttatttggaagcaagggtaatgccttattaatctttgtatccctggagcctagtaaagtaaggtctgttgaaaaaaaatgaatgaataaaataatttggcagtccagattaggtttaccattccttgaaatccacctgtgcattctttctcttcactcctaaaagataagtcatttaattcaatggtactcaaagtgtggatcctcagaatacactgtgttctaaataaatgagagttttctatatttgaaaaaatctatatattgttgtgaactttaatatttaattttttattttttattttttatttttttgctgaaagtaacagaaaagccaactaaacatggcttgtaatactacagaagtttagctgggcgcagtagcatgtgcctgtggtcccagctacacaggaggctgaggtgggaggatcccttgagcccaggattttaaagctgcagtgagctatgattgcaccactacattctagtttgggtgacagggtaagaccctgtctctaaagaaaaaaaaaaaaaacaaagaaaatagagaaggctgacagtaggtaataactggagttgatacagtgacccaacaatatcagggttctgagtcagtgtcttaccctcatggcttcaagatggctctaacagctcaagacactcggtcctaatcccatgttcaatgacaggaaacggggtggaaaaggtcagagtatttttcctcatgcaactttctcatcagagaaaaaatatccttccccaaatttatctaacagaatcctacttttatctcattggcaatatctggggcacatagctgcccttagtggcaaaggagactgggaaagtatccgttttttcagcttctatagtggaaaggcagccagggagaggcaggtaggtgatgtatttggggaactgaccagaaagtcttctagactgtcaagaaaataagtctttttgaacctgtgatcgtatcaatgttctggccaagtaaaatactaaatattaatcaatgtagcaaaagcacacatttagagcagatttcccctctccacatgggtatatggtattttaagggtgccaaatcacttttatggagtgtgctaacttttagagactgcaccttgcctgtgtgtgtgtgtgtgtaatctcatagggtttctattaagtatggatcaaaccctcaagttcctggaaaagagtaaatattcagtaaatagttgtcctttgagtggagtgttgagtttgggagcttcaaaacttcacagggacatgggaaaggatttagtgaggaaaaaaaactgatgagtggtttgctgccaatgccttggaaggctggtttacagcatctgaatgtctttaatttggatcctaggagcctggagggaaacttaacaagagggaaaagaagaacctagggagaggtagtggcactgacaacttggttcaacagattatctttggggaccttctctatacctgtactggggaagatgtactactgcccccctcccccacacacagttcaaaatggtccctagcacacacacacacactaaaacttaaaaagttgaagcatgaaaagagtgtatattattgcccgctttgatttaactttctcttttccagtagaatattctctcaaatacttacagaaggtagtttttggacatcatggtgggagatcagataagcaagtatcgagagattgaaatttaatgattacaattgtcttagatttctcatcaatgaaaagaatggagtagatcaagcttgtccaacctgtggcttgcaggccacatgcagcccatgacagctttgaatgtggctcaacacaaatttgtaaactttcttaaaacattatgagattttttttcaattttttttttttagctcatcagctatcattagtgttagtgtattttatgtgtggcccaagacaattcttcttccagtgtggcccaggtaatccaaaagactggacacccctggagtagattagcagtggtattcaaactttgttgcacattaaaaattacctggggaggtttttttgtttgtttgttttctgtttttatttttttttttgagatggagtctcactgttgttgcccaggctggagtgcaatggcgtgatctcagctcactgcaacctctgcctcccaggttcaagcgattctcctgccccagcctcccaagtagctgggattacaggcacctgccaccacacgcggctgatttttgtatttttagtagagacggggtttcaccatgttagccaggctggtctccaattcctgacctcaggtaatccacccgcctcagcctcccaaagtgctgggattacaagcctgattcatcatgcctggctggagaggtttttaaaatcaagatttatgagctgatcctcagaccacttaaattggaacctctgggaatggaacccaggtatcaatattttaaaaactccctagatgactccaacatgtgcctgagtttggaaactatattagtttgctagggctgccattcaaaggaccacagactgggtgatttaagcaacagaaatgtttcttctcacagttctggaggcaggaagtccaagatcaagggttggttgatcctgaggcctctctccttcacttgcacctgaccatcttccccctgtatctttactacagtcttttctctgtgaatgtctgtgtcctaatctcttcttataaggatgctggtcatatattgtgtcagggcctagtctaaagagctaattttaacttgattacctcatcaaaggccttatctccaaatagttatatttagagcccctgaaggctgggacttcaacatgtgaatttgggggagacacaattcagcccatgaaagaaaccattggacaagtacaacatttctcaaactttaatgtgcgcaccagtcacctggaggccttattaaaatttagattctaatccaataagtctaggtggggtctgagattctgcagttctaacaagcccctagtgatttcaatgttaccagtttacagatcatacttgaagtagcatggttctgtctagatgagtggttctcaaactttaatggacatcggaatcacctggagaaattgttaaaagcagattgttatgatccagccccagaatttctgattccataggtgtcggggtagagcccaagaatttgcctttctaacaagttcctggatgatgttgatgctgctggtgtagggatgatacattgcaaaccatgtatctctgacattttgagactttatggtattggatgagtcagggtcattacatacatcattgtatgtgaagtttgtaattctaattgctgatagcattactttttttttttttttttggacagagtctcactctgttgcccgggatagagtgcagcggcgccatctcagctcactacaacctctgcctcccaggttcaagtgattctcctgcctcagccttccgagtagctgggattacaggtgtctgccaccatacccagctaattttttaaaaaatatttttaggagagacgaggtttcagtatgttggccaggctggtcttgaactcctgacctcgagtgatctgcctgcctcggcctcccaaagtgctgggattacaggtgtgagctactgtgcccggccagcattacatttttctttttgccaagcataattactttttctgttaataggacgaaggatgagaaagtgggagaaaatgctgtattgggatttcttttaatctcatacaaatagaagtgaataaatacagaggctacacatcagcccattagtctctattcatgtttgttctccaatcatagagctattttgcagcttgctcttctagaagctcaaagctgattttatgagattggttgcatacttctcatatgcgatttttaaaggattaaccattctagagatttcatggggcattgcaaatttcccccctaaaacattaattttaaattatttctaatttaatcacacaattgtttctacacgagaccaacagtgagctacatcaaagagtatcccctccccaaaattattggatatgaagaaaatattttacctgacttcatagaattaaatcggtaaaattcacattttgttactgttattagaaaatttgatatatatatatgtgctatatataggtgatatatatacacacacatacatatacgtacatgtatattgtatacacacaggttatgattttctatttgcttaatttaaagcattttatgttattttaaattgttcttaaagctctatttatatctccatatgaaacagtgaaaatatttctattttaaacttaaaaaggtattcaacttgtaatccaataagtattttaaacaaagatgtaatcaggtttctagctgccccatttactctgggcctattatctaaagaatgggtcttgctaaagtatttcccttacaacttttccaaagttatgccagatgtatagggcttctattaagaatagatttactatgccataactgttttgagtttaccctcatagctttcccacatgttccacattcttggtgaatttttccagtaatgcacctcccagcactgtcaatgggaagaggttacctgtcatgtttctagcctgagcttctgaccaccagataacagaagcccaattgtggagatggatacaacaagcccaatgccgttaaagatctgaactgtataattaattctgtttctcctgacttcatgctcagcagtcagccttaggatgccacatgttcattgccttcagggtgagaataacctggtcagagtgtctggtctccctgacagttatatctcccattgtaaattactaagccgccactctagctttaaacacttatgagtgttgtgggtgtgagtcagcacccaacaccctcaaacctaataaatacagggacactgataaagatcagttatctgggggttggctcaaagctaggccctgatgctgatgactcatcgaagtgaattaataccagctagcatttattaagtattttctgcataccagccactgtgcaattttatttatattatcttatttttcctcataacaactttgtgaggtagtcatgttaatttccattttacaaataagaagactgatatatgtatattaaaaacctgctctaaatcaaatgactattgtggcagggactttgagttgccatgcaatatctattcccaccttctcccttagtggcagaataccagttttattactggtaatgatgtatctagcaaatagtttctatttcctggcatcccttgtatcaaggtgtgaacctatgactgagttccaccagtgagaggtaattgtgttgtgtggtacttctaggaagcctgcttaaagggatttgacttggctgggaggagggcccttttgtacctcccccttcttcctcctgctgttagtcttgaatgcaggcatgatgcctggagccatcttggaccatggagtgactgactggatgtaagctagcattaaagatgctggaacagaaaggtagaagaaatctgggcctgtggtggcaccatggagctactgtgccagctctaccacagagatctttgtctgctattgaaaccaattggcattctgtcagcagagatgaaaggtagagttggctattggtaggcagtggacagtgttttcatgctatataccaagtacctaatatttgatctgtgatagatacatgtgtttgagtttcatctctgccacttactagctatgtctattggacatcttttgtgcctcactgcacagccttatagcctaccatttaattaagccgttagtccattaaccagctttatgtgggtaaaaccagagagtgccttgccttagcctcacagcaaatatctcacttctcactccaggacttctttgatgtttcaacaggaaggcctgttggaacactcttgtacccacacatgtgtgttatggaatgtgagggagttaaaggcccaagagccaacccttgaccaatgtgagatgggaacctaagataaatagtccctcctccatccttggcctgataattctcaattgccttttaatagtgtttgtttccaagagattctcagagggtctaactaagtaggattacgccctagttgtttacagttgtgaccaactcaaaaatacactcccgtattggttttctctcttcttttcctttcctgaatttcctacttctattccctagtatcacttccccaaacaaactacctacattgaaactcttgtttcagcctctgtataaccttctgtgtaaccttgaagtaagctatgctgacaaaactttttagcacttgctgacatttttatgtcccttctatgatgaggcaaaatactatctttggtgtacaaagatgaaaatacatcatgagatctgataattccaactattgtatgaatgtggatcaataggaactcatactttattgataggagtacaaattggtaccattctggaaaagaaaatttagtactgtcttgtgaagttgaacattttgcataccctatgacctagcaactttatttctaggtatatcacctagacaaatactcctacatgtgaagcaggaactctccttaggaatggccatagcaacatggttcataatacaaaaattctgaaataatctaattgtccattgatggaaaaatgataaataaatttggtattaattattatttcaacagagtaaaaatgaattaaccatttctctatgcaagaacacagatgcatattattaacaaaatcaccaaaaacttcatgcagttgggtatcatttttataaagcccaaaaaaaagcaatactacacaacacattcttaggaatcatacacacatgatagatcctaaaacaaggtgaacccaaaattcagaatagtactggggagacagagatgggataaggtaggagcagatagtagaggtacgaacattgatgatgttctgggtcttgaatgcggtgatgggttcataaaggctcatttagtattactctttataacttatttaaattgatacagattcttttatatacatcagattttatgtaataatttaaagaaatgaaaccatcaccaacaaagatgctgtactaacaaaggacagcctcagtgaaaagcctcctctagccctcactctaaactaatggctctcagagtcaatgtttctcatcatgtaatgtgtttttttcttttgtgttgttaagtatattgtaatcaactagaatggcagggtacaagattccgtttttcttacggcccttcagggtcacatcctctagtatatttagaaaaacacagtttgttgtgtcctctctgcgcctgtgtccatttgcctgtgattcttctatatgtcctgaagctgcccattgctctttgctgtgcacaatccacctcttattttactgctgtctcagcacagcacacaggggctacgttcctccttgtttcgtgtgtgtgtgtgcgcgcgcatgcacgtgcacaggcgtgtgttgggtaaaatggtagtgagtagggaggcagttgacatgacctttttctttatacttccaaacctactccttgctttccttaacaatgccaccaaacaaagcagtaaaactgtaccagatttttgaattttgggccaggatttgtaatctttaaatcatttgtgccctggaacctttgatgaagtcggtgacctccttatcagaatggtggcttaaatacataaactcaaactcactggattacaaaggaagcaaattgtattgaaatacggttatcagaaattaaaagcaattgtgtggtatagtactctatgtactttttaattaagttattaagcaacaagatctaacggtggatctaatgacctaaattttaaagtagtaatgattttgaaacatattacatgatatctacaataactgtaatatgatatgaaaaatatctgtttctttagtgacagtcacgggtactgctaatactactgtggtttgttgcttacattcatacttgcaggaaatattaaatgtcagataaagattagtgaacataaggatgtcatttttttttcccatccaagttcatggactctttaaattctactgatatattcttgggggttcgtggaccccagattgagaaacttgctctaagcaaagcaaaggaaactacaacagatgtgggaaataattttaaactgaataccaaatattacctaacccacagcctacagagaaagcagttacctctaacctttcatggagggtaggagagccgtctcagtttccattcttacctcacagatctttttttttaaataataataatagctaccatttattgagcacctactctactgtgtgccataagaggactttacttttcaattttctgcagacaagtctccatacttccgttaggaactcctgcctccttctcaaaggatctgatcttgctcttggattcatcagtcttccttctccactaagagttgcccactttagaataactccctaatggctcccacacaacagcataaggtgggctttggcaagctgagtcttgtttcatttaagacctttacactgcagtgagctgtaatgagcggagcccacgcacccctcctaaccttccactaaaacacttactttcagggatagcacaatcttaatacataaggaaaaagaagcattttcctgacttctccataaattaaaagactgcttaagcatacaggaaagctagtactgtacacttattatgcagatcaggtatagttatttattcataccatagctgctttcaaatgggctcactactgagctatatagatcttgtgatggctgttttctgagctacacaaacacctggctccaagtttgaagtttctgtttgtatgagtctgattaggtgtttagatagtgctacttgtatcttctacaatacctactggttgaatgactgattgattttaattattttttcagaattagtaatggatttttaataaactttatttttagaacagttttggtttgcagaaaaattttgaagatagtagagagttacgtatacctatatccagtttaccctattaaaatcttacatcagtatggcacatttgctacagctgatgaagcaatattgatacatcatcattaactaaggctcatgttttattcagattttcggaatttttacctaatgtccttattctgttccaggatcccacgcagtcttcatgtctccttaggctccttttggctgtaacattttttcagattttctttgtttatgatgatcttgtcagttttaaagagtactggttggacatttcgtagaaagtccataactgggatttgtctgatattttttactgattagactggggttctgtatttttgggaggagtgccattctcataacatcatataaagggtatatactatcaacataacttatcattgttgatgttgaccttgatcacctggctgaagtagtgactgtcagatttctccaccataaagtcacatttttttctccctttccatactgcatgcccatatttaaggaatcaggaattatgttccacctccttgaaggtatttacaaaaattatttagaatttttctgccctttaagatttgtctcttccttccttcatttatgtgtttatttattcaataatttatttgtatttgtatggattcatggtaatgaatttttagctaaacagctccaatcttatttttggccagtggcatgaatttctgtcacaaactatggctagccctatagttcctaagcacagaaaagagtaaaaccaatagctacatacagaatttgtttcactattggtctattcatctatctctttccatttccttatctaattttttgtctaatttttcaccaaaagaataattcagtaacattaaaaaattcaaacataaaagagcacacagtgaaaattgctttccaccttttcatgtttttatatccctcttcagcggcaactcctgttaactgttactgatgtttttttcagacgttttcaatgcatttattagcaaatagctatcattctgcttctttatactctaaggaaaaaggccaggaaagggacagcagggcaacaaaaggaaataagaaaggggagggcaggagcaaaccaaagattatgaggttaatcatagaattcttaattcagttactacatttgcttggcaaacaattcacttttccaagatttttttctggtgtagttttcccactattgtgagtttcaacccctgatgatcaagcagtgtgggtatattacttaagttttttagttgaaaacaagtaaatcccctctgcccagtttaagcagaagagtttatttgaaggtattaggtggtatgatttttatggccccaattgtctccatccctaatcttgtcttttggacatgtgactttgtagtttctctcactaaggataatatctatatgtcccttgattctgaggttgactatgtgacttgctttggtgaaggagatgttagtggatatgaagcacatagaggcttgaaaaagcatgtgcacacttctacttctgtttttgttcctctgtcaacttcaggaagatgacaagagccaaagctagcctgctggaggatgagagacatgtggtacagagccaagtcatgaaagttacccaagctgaagctatcttggattgtctaacagccacttgatctccaggcatttaggcaagctgaattgcagctgactatagatatattagcaaacccagccaaaatcagccaaggccaggccatctgaactctgtagatttatgggataactaaatgcttatttttgtatgtcactgaaattatagggctgttgtgcatcattttatggcaacaaataactgaggatggtacttcaaggaatttctgggagaggcagagaacgtggtttggatgctacatggccagaagtaccagtaatcacactgcaggatgtttctagcaaacactttgcccctgctgcctcatggtgctcagcatctgtcattctggagaatagctattagaaccttcaccagtgctctccaaatgaactgaatgccttgaactcactgcttgaaagaatcactgacatccagcacaaagttcacattctcattccagtcatcccgtggatgcatctgactactagattataaaccacaattagaactctagctgcaagggagtctggaaagtgtgagtgagtgtgtgtgtgtgtgtgtgtgtgtttagctttctagcatctgcagtacaagaaggcctgctagaaggggtttggagaaagtgtgagtcattctccagtatcagccatggaggcatagacaaaagaactcaacttcccgatcccctgagtttcttctatctctgcatagagatggtcaaggtgttgacaggacttagaatcccgaggggaggacccctggaccctttgactactctacacagaacttgacatggcagttttagctctagaaaagcagtttcattctgatattaatgactaggggtactccttgtttttcctcccttggcatttggcaaagtgagtagccaggtgaaacaacactttattctaattacgttggacactataaacaaggagtttgacctcatttcacgttctctaaagctgagtaaaaggttatagtaaaaacacttagagaagtatattgtatattcttatatagggagaatataaaggaagaaagaaatctctgtctgccccatattcatatgccaattccctttgatctaagtatcctaaatacctaaaaggtgatcatattaggctgatacattgtaaactcacccttgctctttaaccctactcccaccacaagctagaatggttgtctgcagtgtctggtctgggacacatgtcattaactgattgatagaagacatttccacaaaacgaaaaggctttggatatagatgtatttatttgtaaagtgccacttgtaatattggccacatgaaacctttatttgttctcctctatttttcttctgaagaccttgttctagctaaatatttgctgaaacatttttgtaacctttttgtgttttaacttaataggcaaagccatgctgttgttgacactaaaagcacggaaaagaattacatttgggcagtattttaaggggtgcttttaaattaatctgggtgagaaattaagtatacctcgtatctgtatagataatatctgaatccttgactggttaccagtaaaagtaggagaaaatccactggaatatatatatgcttctgaagagcatatggtctgtgaacattcccaacagtggaacatgaccagagcatttactgggaggatcaaaagatattctgatgttgccaggatgctatttggcccatgtggatttgcgcattcaatcagtaggtttaatatcctttgtaatcaatgaaaaaatctgaataagaaataatagtccattcagctcacagggaatttgtgataaccactcattattattgttatttcctgaagtagtttaccttgtattttaccaaaaatatttgggacgaggtctgaaacttctgctcaccaaggtgccaaactggcatcaagacttcaggccatggaaaatctacctccacagatggagtcaaatctgtggaggtagcttttcctcctacacctctcactgcagctcccactactcctctccctgtagaatcgtctcctccagccaattggtagaactactggactctagtgatatcatatacatttctatattttttctgtaccctttgccatgcctagaggacctccctggctctctcttggcatctatgatctgcctggatgagatcaagataaaacttagccataaatccagaattcttgtggtttgctcagcctttgcccaccattctcttctctgaacttctaccatgtttatatctagcatctaggctagcccttctgtgcccccaatatgtctactcatagctaaaatgttagtttctggaggatagaccgatttgcaattctgtgtatccccattccctacatcagtgccatatggatacaataaatactcagttgatggaatatgatgcctagaacatctagcacaaaaaccacaatgtttaaggagcaaaattccttgcatttacctggagcttccttcacaggcccacctgactactgacttcattcttattcttaaaagggtcacatgatccctttcttacaaaggtcacatgattattttactgcttccctccagtaatagagaggaaagggctctgtattggtctttcatctcaattttctccttgtgctttctgtgcatgaggtgccaaagcagtgtggcccttgatctactcgcttgactgattctattgtttaatcgccacaacaaccctaagagtaagtgccattattattccaatttggagatatggaaactgtcatggagaagttaagtaacgtattatctcaagctattaactggaggagccaagattcaaaccaagacattacggctcccaggtctgtgctgttaactcctatatgaaactgtctttcctgatgcccaggtattccattagatgatccttgaaacctcagagtttcttgggtcagaaagtttaagtaaacggaagaaattacagatccgggaacctcttctgttattctcattgtgctaccaagaatcccacaacatcctcttggtggaagaaacaaatgattaggaatttagtatatgatattccctcaaggctgcaaaatacagtacttcagaattattcacatcattaagatcaaatctggtctataagtaaatgcagattcaggatgtgaattcacactaagtaaagtacagtggttggaattctgctattgccacttaccagttataatatgggtatgttactttacctcttttatctggcacttagtaaatactaaataagtattaactactatttctataccacaatatttccctgtttctctagccatctatgcttccttacaacaaagcacagtgtaaagctctttgcctccacctcattggattaaataaacaggtctgtaaatataagagggaacaataatagtgaaaaaattggatactcaagaagtctagatgatcagagtgactttgtttcttttgttaatgaaaggatgagttggacggaaaaggagtgagtcacactgacaacgaaatgctaccaatttaggatttgattcattattttatgaccgttgcttgtttcctgatgctattcattgcttattcattggaggaacaataatcccattttggcttttgtggttttatagctgagacatccactttgaagcacattagctacacctctccctctccctactacttcatcaccatctcaaacatcagaaaatcaaattttgaaaattgcccagaagtattgggtgtacaaaaacattggtttctcctttggaagttcttcctgtgagggtttaagcatggggattttatagaggagatgaacatcagggatatttgtggcaatgtcacttcccttctcttaaaatggtgttggatggagagcctccgaggtaaagattctcaaattgtctgcagttataatgtccaaatattcgggagaaaatcccatatggcaagcaataaaacaaaattattatgacttccagttgatgatccatttttaaagggatagtttgaagtaataaagtaagtaaatattagtctagggaaaatgtggatatactttatgaactatttaaatacaaactatcttttcattttgtgccatgacctgagactactcaatgaattttccatatgtatacatttgctcttacatgtgccttttggcaatgccctttattatccttgaaaacaaaggcaccactatagtataattcaaatgtgtctagttcttcagtccttagagattggtggaggggctgcattacctctccctttaatataaactaggaacatgattatttgagaatgttgggggtcactttcctctcccagtaagattgaggaaccctgggtatttttacgtgtgtcacaagcttaacgtgaattttctcttgtcccctcacttagtatcacatacataacagcttttctttcagtcacccctgcttcctagtaactggttctccatgatactactacctctctctgacccatttcatccccaaactgtggaaaacagcctctttctcaaaacccagctaacagaaagttgtcttgtttaaggcttgaggataataccagggatttacaatgcagaaaggaaatttaaaacttggtatcagatatattgtgctttccgtccattggccctgcccttttgcagggaggcacactgtctttactctccttatctcttggcctgcagccatgttgcagatgtccacttattcccctgctgtaagagtcattcttttcatatcctcaaatctttcttttcctctatgccagaagaagcaaaagctgtttacaaattgaccctgggcataacaaagacactgttctacattattctacagaatctgttcatggtttctccactagtttagtcttgagtgtgtagtaatctctcacctgcttggttacaaagatgcccttaagtagtgtttccaagaatgaaagaagtactgtttcatttattactctgaagagtaaaaatgactacaggttcaaaaagcatttttgatcctctagtccagtggtttacaaaggggaaatatgactatggaatctataacaaatataaactttatatatatataaagaatggcatacatatacgtatatatatatatctgtgtatatatatacaattctcagatatattctcaaaaggtttaactccaaaggttaaaggtcatggaactcatgtgcttagcagtaggaggggctccttgtgttagaaaaacatcactaccaacaacaacaattaagactttgcttcaaagaacactgaaacccacttagtcaatattgtgaatttcacctgcaaatcctgtttctaatttgatttaagtgcttatgatttaactctttattaattaccttggtagaagcaggtgacattcttagttaccataagacttttccctagtgtgttgttcaaaaaacattggtgttatttgaggaaagacttaatagttagtgacttaattctaagcttctgggtttatttcattcagttaagtatttaggcatatgtttaagaggttcccgccaaggttctgacactctaccagacaccgaagatgattcagacacagatgccactctcataaagcttatataacctcttggggaaaattgacacaatataaataaatacaaagtagaaagttctgcatgccctaaggtaagtctagataaaaagtaaatttacatcacttggtatgcaaggcagtataatttctctgactggcactttccagtagctacgtagggcatccagctttagcttcacgactttgaatcccatcagtcatgggttcaaatcctacctctgatacttaacgactatatggtcttgggttattcacttattttcactgaactttagtgtccccgtttatacagcaagcttactaatacttcagaggttgatgatgaggattaaatgagataacatatatagtatataaagtgtgtggcacatagtaggtacctggaaggtggcttctcttttcccattgctccataaactgaccaaatagatgtaaataccttaatgcgtgaatacttattgtatagcttatagaagaagtaagaagttacatcttccaatctgaaggcataaaaattttatgaaatacttgtaagttactttatcatgaagctttccctgactgccctatataaaatagcaagagtactcctaacctcttttttacttcatttttccctaccacatatctgaaatattacatatttattgtttctattaatttttgttgataaatattagttatacatataccccaaaagttgtacatgtacccaaaaggagtacatgtggtattttgatacctgtatacaatgtgtaatgatcaaatcagggtaattgggatatccatcacctaaactatttatcttttctttgtgttgggaacattacaaatcttctcttgctgttttgaaatacataataaactattgttaactagaatttccctactgtactatcaaatgctggaacttatttttttttatctaaatgtctgtttgtatcccttaagcaatctctcattccccctccccctacccttcccagcctctgataccaccattctaccttttatctccatgagattcacttttatagttcccatatatgtgtgaaaatatgtgctgtttgtcttctggcttatttcacttaacgtgatgactttcagttccattcatgttgatgtaaatgacagaatttcatttaaatttttaatcttttctaatctttttatggccaaatagtattctattgtgtatatataccacattttctttattcatttatccattgatggacacttgggttgattccataacttggccattgtggatagtgctgcaataaacatgggagtgcagatgtcgttttgatatacagatttcctttattttggaaatattaccaacactgggattgctggagcatatgatagttctatttttattgtttggaggaagctgtttactgttttctgtagcagctctgctagtttccattcccaccaacagtgtatggtgttccctttttctctgccagcattttaaaattactctttttaataatagccattctaactgggatgagattgtatctcattttggttttggttttaatttttttatttccataggtttttggggaacaggtggtatttggttacatgagtaggttctttagtggtgatttttgaggttttggttcacccatcagccaagcagtatgcactgaacccaatgtgtagtcttttatccctcacccccctcttccctttccctcaagtccccaaagtcaattatatcattcttatgcctttgcgtcctcataacttagctcctacttatgagtgagaacatatgatatttggttttccattcctgaattacttcacttagaataatagtctccagtttcatcgagttttctgtgaatgccattaattatttcctttttatggctgagtagtattccatcatatatatatgtaccacaatttctttatccactcgttgattgatgggcatttgggctggttccatatttttgcaattgtgaattgtgatgctataaacatacctgtgcatgtatctttttcgtataatgacttattttcctctgggtagatacccagtagtggatcaaatggtagctggatcaaatggtagttttacttttagtgcttagaggaatctccatactgttttggttttgatttgcacttccctgacgattagtgatgttgagcatttttcatatacctgtttgctatttgtatatctacttttgagaaacgtcttttcagatcatttgcccattttacaatacgattgttttttgatattgagttgtttaagttccttatgtattctagttattatttactttttttttttactggctgacccccctccccaatagaacatgtttcacaagagcaggggctttgtcattacactgctgtgttcctggagcctagaatagtgtttaaaatatagtcagtgtgctcaataaatattttttaaatgaatgattgcaggaattaagtaaaattttaatcaaataaaatttaggatttttctattggttttagtaataaatagaaaacttttgacaagtgaagtggtagtcactgctatattggatactgaggctttacaactgcatcatgtctgttagtaatggtcatctcttagctattttttaaaaaattttcatgtgggctaccagtctccagaatctctttctctccatgaactttatcattctctctcaaccgtgataatttatttctgtcaggggtatccatgatttcatattttaaatttctaatcttcgtttcttttttctctctgactcagtagtttgtgtgtgatagttgctctgtcatattttcaccagtaggtgccagtatttgatataacttatagagacagatctaccacttatggaggattgcctttccaggaaatgttctctctcttgtagataattcagaaagagcaaaccattctctctgcttgcagtaagcctgtattgaatcttctttacctacaaaaagatggcatgattggggggtgaacaaaaggctctgatagcattttttcacataaataaatgcaaatccatatggaatccttctgacggatatgtctacatactggaaaactttaaaagatgtatttcaatcaacctaaaagttaattatgccattccattcctcaaatattcaagaaagtcttccatgcatttgggctacacagcagcaaatccataatcatggttcccagcttgcatattagttttagtgttttgtttaaggctctctggttgggggaagagtttaatgtaagattaccttaaaccaaatcaagatactttcgagaacaaagggattcttatgagagactaaagcaggtaaacaaaggcagctccgactgataaaatacttgtttgaaggtgtgtggaggagatggtggtatgcaacttttaaaaactggcagggctaggtgtggtggctcactcctgtaatcccagaactttgggaggtcgaggcgggcggatcacaaggtcaggagatcaagaccatcctggccaacatagtgaagcctcgtctctactgaaaatacaaaaaaaaattagctgggtgtggtggtgcgcacctgtagtcccagctactcgggaggctggcaggagaattgctttaacccaggaggtggaggttgcagtgagccaagattgtaccattgcactccagcctgggtgacagaacaagactctgtctcaaaaacaaaacaaaacaaaacaaacaaaaaaactgacagaattcacagatactccttctgtcttatcgtgtacttgccctggattctactctatagcatcagtcaagccaccataacttttcttggaagtgaaaaaatggcctgaaaatatggctaatccccaagataactttaaaatactttcagaagtagtttcaaagaaaacacaatggaaatggtgaggttatacaggtctggctcaaaccttgtgtgagttgatatggaaaagaaaatttgattttattacttaaatattttacatgaattgcaaagaggaagtgaaggcattacatatatacctgtccagaatcattccctgatttcatgacatttccacatttgtatctacttgttcactgcccatgcatgggggctgtatcaagttttgggggtcctgcaccttatactatttaagtggttgccattaagaaaatggttacaaaataaatatctcacacattcaacctaactagtccccctttccagagaaggagctttctcatccattcactgcagtcccttacctaatacataccctcacaccgggggtcagcaagctactgctttgtgagccaagcctggatcaccacgtttttgtattagaacatagccacatccattcagttacagattgtctatgggtacctttgtcttacacttaccaagttgagtaactgccacagagaccacaaagccctgcaaagcctaaaatatttactctctggccaactacacaaactgtttaccaactcctgccttacacagtagctgtgggttctagccccacttctctctggatctacccaagagaatctaaaacaaccattcaccacatcataggattgtataagacatcaggttaatcaactggacaaaccctcgtgccttttgattttgtcttctaagaagtccaaaatcaaatttagtccttattataataactcatccctgattactggcacaattatttttccatttctcattaaattttattttttctttatcttagtccagtggtagtgactttttggtaagccatcttatttcttatccggaaggtggaatttaagtggtaagctaacatggtaaattattatcagtctgcctaattagtcatatgtgctttagaatatttaaagcaggactaaaagttgctatttttaaaaagctaccttggagtttgtgcttgtaactcccaaggtgaagacagaatttatcactgggatacctgagcttttgtgtacacaagaaaaataatattttaatgcatctcttagttatgcagaggcaaagcccagatcttacaatgcataaaaatgtaaaatgttgttttctttggagtaagactgcatctctggaggattattgtgctattaatgggcttttcacctgttttttcttccttaaagggagtgtgttgtaggcccaagagtttgagagagagcacaagacagaggtcactaatctgaggagataagggcttttcttctcagcaacaggatggcatgctgagtggctaaagaggaagggggtcaatatgagacctctgggaatgaataagacctgtgggctctagaaaactcagaacaggttttaaatctttccagattagtgtttaaattaccctctgtttaccacaaagcttcaataaagtttttaaaataatagcctactgtttattttgctttggtaaaagatgggcaaggctgtattatgctttgcatcaactattgttgagataagtagaagtgaagaaggtaccatgcagaggaaaacaaaagggaggggcagttacaaaatggataggggtggtctgaggaggattgaagaggtgatcctagcctgatctgagacaaatggccacctttgggaaacctcagaagcatttgaggaaattatttccttttgctaaatcaaaagagagatctcagaaagctggaatgccagagttgcttatgtaaagcactttgacaaatatgttattagatgactttagggttatgaatgagagacgtgaaaactataactgatttggttttcatccttctaaaaagaaaaaaatataataagaattcagaattcagtcaggctgcacagaggttaactgaaggaagttagctgaaaattaattggaattcggggtcgacttctagttaagtcaaatggaaccattaactttagggtaaaacctgaaaccaacaaagaccaatccctctcaaaaagatagagagtctcttgttttcatagcaaatgtataaaagggtaagggcacctattagggccttaccctagtagattctgtgtcctgacaacctgacccgtccgctgagatggtaaccctggtttaactagttggtaattccagtttgcttaagcattgagattgctatgttgagacagctggttatccttaaatattataatttacttttttattttaatagaaccccagatttttagctgggcacatgtgtgctcagaatcaagattatatttcctagccttctttatagccaagtttgaccatacgaatatgtttttgtcaaagggatataagaagtgatgtacaacatccagaagctatctctgaagagagaaaaagcctatctttattctttcccttttttcccttctttgtggctggagtatagataagatggctagaactggagtagtcatcattggcaatgaggtgacctatactagagcaacaagatagaaggagcctgggtccttgacatgatgaaactgccgtaccaatctgactgcctttctctagacttttacatcaggggaagtacatttttccttggtcagctacttttgcaggtgaatctcatcctgattaatttcgcacaaaatgctcagctcccttgaaatgaaaacattgtgtcttagttgttaagtttattttctacccatggaacatgaagaacaaacacagggtttgcatcagttatctctctctactataatgctgtgtaacaaccacaaaatctctgtgatgcaactcaaatttcctccatgtgtccctcatcctccagcaggatagcccaggtatggtctcatggcaatgatagaggaaaaagagaacaagtactttttcaagcctctagttgtctcatgtttgttaacatcacattttccaaaataagacatgtgcctggactcagaatcaaggggtaggaaaatatattgtctcttgataggaggaactgcagtcaattggcaaatggcatggatacagggaagggtaaagaatttacgtcattatttcaatcattctaaccttcatattaaagttttaaaaataagcttagaattaaattttgggataggttttcataataattgtaatactgtatccatttggtatttaatggttttgcaatatcagagagaatttggcatgttagagaatatgcaagacttagattatgattccaattccaaatgtaagattttgtcattgattttagtcttttgaatgatatttggaaagtgtgagataaatttactaagttagcaaacagtactgaaggcctaagagaagttcaggttcactaggtctcaagttgaatttttagattttctagcattaagttttgtgaaaatatcttatttggtactcttctgaaatgttagcccttctaaaaggctttccctgaccattcaataaaaagtgactatatcactttaccttctcttctatagagcatttatcagtatctggaatgataccatatacttgtttattacctactttacccactaaaatacagtctccacaaaggcaagcattttgttttgcttgctgctgtatccagaacacttataaaggagcttgatatatagtaggtgctccaaaatttgctgaatgactgaataaagctttggttttaggtcatggctttgaaatacttaaagagaaattttaatataataaatttatgaatgtaattcaaatcctgtaaattaattaactgaattataaacagggctaatagtttgaggagttcagtctgctcaatttgagttgactaaatattaattaaaggttttctagtcagtggctaatagtttaaggagttcagtctgctcaatttgagttgactaaatattaattaaaggttttctagtcagtcactgttaaaatttagtgtgtatagaaatagaataataggatttgcaaactggtcttaaagacttataggaaagctagcttgttaaatgttgttttagtaattgaatattatttttaaaagtaaattttaagaattaaaaaaataaagtaacaatactgattatttctgaattaaaaaactgtgcaaggacttaggaatcctcatactgtccacacgaagtctgtatgatgcacatatcgaggggcatggagcagtaaacagctgagtcccagagaaggagcgaggagacattatttactgggattgctgtcactgtggagaatgatgatggtgtaacacaggaaatgtaggggttggggtaaaatggagggggagccatctttactttaaagagatgggtaaaccttttcatgtcttcaaaactgaaattgacttctgtctctccaaaaaccccatgatgagtcaagacagagttgaggagagagaataaaggaatatttaggaggaattatggtagcattccttttataaatcaattgaaaaggagaacaaataaacaattttcaaaggcttaatgataaaggtacccactgagggtgttggaatagcagtaatggcagtcacaatgactctggttttcatcagagcagaatctcctgtttctggctttaattatctaccattttggctatattgtcacataacaaccacctcaaaaactagtggctaaaaataattattttattttgttcacaattttgtgggcaaagaatttgagaagggctcagcaggacaaatttctggttcagattgtatgagctagaaaagatgggactgcgaggttagcttccaagaagaatttttttacccacatgcctagtaccttagtgctctttgatctctcactctctacatgttgtatcattcttcagagcctctacgtgtagcttgagattctcacagcatgatggtctcggggtagttgcccttcttacaggatggctggcttccaagaggcagaaagtaggagttgccagggcagttatggcctacaagtggaactggagtagcattacttccactgactcagttggtcaaagcactcacaaggcctgcacagatttaaaggaggtggcgatatagactccactttttaatggtgcagtgtcaatgtcacattgagtgaaaatggcagagtaaggacctctgaaaattcactcctacataaaaataataagaacactgaaaaatggtcagaatcaacattttcagaactctggaaattaaccaaagggttgcgctaatctggggagcatttattcaagaacaatggctaaaactcattaagaactgcaaaaatttctggcattttaactttccatattcccatccccctctcttcagccccatggtagccttaaaaaaaccaatagcctacaatcagtgaaaaccagcatcctgacagccaccggaaagggtagaacagagttgaagcactctgcaacattccagagaattatcattatttgacctgtctgtggttccctgaaagatcactctcaaagctgtctttattttacctgacttggagcttgctcagtatgtaaagctttttcttcagagaatttgtcaaaaacaacagaggcaattgttgaaccttgaagctgcctgaggtggtacatagattgcaattgaggtagacaataggctaaacaaaaaacttaaatggaataactggaaaatgaaatgtccatgggggcttcaaaaattgtaacatgtttctggaaatctggagggccatgcacatatatagggctctttgcatgctcaagaaaaacctgagaagtctctaactttttatgtctgactaacctcaaggtgctctgcaaataggaagtaaaggctaagttggagttgtaaactctctgcctgagtgttgagggggtgcctcaacatgcactcagagaccctcaacaaagactaggagacttattggtttcagacatgtaaggaaatctcaatctaatcattagctaacagagtagagactccactggccacacatgacaagaaatacagatttcactgaattagtttagaaaagtcactaagcaatcaagaaaccctggggaggtaggagaaattgatttccagagttaccacattatattattttaaatgtccacttttaaattacgaggcatgcaaaagaacaagaaactatggcgtatccacaggaaaaatgagtcaatagaaactatctttgaggaagaccagttgctgaggttactgacttgaaatcagctattttataaagagctgaaggaaaccacatctaaagaactaaggaaaagcatagaacaatgtcttacaagtacagaacagaacatcaataaagagataaagtatttaaaaagaaacttgcaagttgaaaagttcaataactaaaataaaactttcagtcgaggtgttcaacagatttgggcaagcagaagaaagaattagtggacttgataatagactgattgagataatctaatctgaggagcagaaaaaaaaaagaaaaacatagcctaagagacctgtgggacaccagcaggcatactagcatattcataatgggagtcctaataggagaagagagagaaaagacagcagaaataatatttcttttttttttcttttttttttttgagatggagtcttgatctgttgcccaggctggagtgcagtggcacgatcttggcttatgcaacctctgcttcctgagttcaagtgattctcctgcctcaacctcccaagttgctgggactacaggcacccgccaccacaccctgttaatttttgtatttttagtagaggtggggtttcaccatgttggccaggctggtctcaaactcctgacctcaagtgatcagcctgccttggcctccctaagtgttgggattacaggcgtgagccacagcgcctggccgaatgcttcaaaataaaatggccaaaaacttcacaaattcaataaaagatatgaatctacacattcgagaatccctatgaattccaagttggataaactcaaagagatctacatttagacaaacaataatcaaactgtcatcatgaagagaaacctttgaaagcagcaatatcatcacagatcaggaatctccaataagattagcagcaggtttcttatcacaaaccaaggaggacagaaggcaaagtgttgatatatttgaagtgctaaaagaaagagactgtcaactaagacactaagacttctatatctatcaaaactatcattcaaaagtgaaggagaatttaaggcattccggataaataaaaacagacagaatttgtcactagcagacctgtccaacaggaaaaattagagagtctttcaggctaaaatgaaaggacaccaaactgctactcaaaaccatgtaaagaaataaagaacccaggtaaagataactacatagttaaacatatataaagtatagcataaatttattttttctttttaactgttttttctcctctttgatttaaaaggcaatttcataaggcaataattgtatgtctgtattgatgggcatgcaatgtttaatgctttaatttttatgacaatatctacacaaataagggtgcatagaatggagataaattggagcagtgttttttgtattatgttgtaattaaattggcatgaatttgagccagtttgttttaagttaagatgttaattgtcattgccagggcaactactaagaaaatatcttaaaaaaatacagtaaaagaaatgacaagagaattaaaaggtacaccagaaagtatctttttaacacaaaataaggcaataatggatgactaaaagaacaaaaaggcataaggcatataaaaaataaatttcaaaatggcagacacaaatcctgcttgacgagtaatcgcattaaatataagtgaattaaacagcataacggatttttaaaaatgatacaactgtatcctggccacaagagacatactttagattcaaagtcacaaatatgtcgaaagttaaaaatggaaaaagatataccatgcaaatagtaatcaaaagagagctggagaggctattctaatatcagacaaaatagactttaagacaaaattgttgctagagataaaggaatacatttaataataaacagtgtcaatccaacaagaagatatgaaaattataaacatatatgcacccacgaagagaacatcaaaacacatgaagcaaaaattgacagaaaaacgtatgtgatgggagatattgttgtggccatctttagaaaatataatctgccacatgcactagaaaaattacactatgtttagtattcacattatcttgttctagtaactctcatttagatatctgttatagaaattaatggactgattatccctcaaatctcaagatcatttattaagacttcacattagcatccagaggctgaggaggctgaggagttcatatgatacagctcatataattttaaaaagaaagtatccttttatctaggcttttcatcttttatatataagcctgccttcccctagaggtctagatataatgtattgatagccagctattgaggactgtaggtgattcactcacctccgacttctagaggcaaattcttatggtcaaccaggaagctgaggcttccttcattgaacatttagaatgcggttattcacccaacagttgatatagtccatgtcatactcataaattgttcccacaaggggacagtatatatcaaaacagactaggtgcagtggctcacgcctgtaatcccaacactttgggaggcagaggagagcagatcacctgaggttgggagttcgagaccagcctggccaacatggagaaaccctgtctctcttaaaaaaaaaaaaatacaaaaattagctgggcgtagtggcaagtgactgtaatctcaggtacttgggaggctgaggcaggagaattgcttgaacccgggaggcgaaggttgcagtgaaccgagatcatgccactgcactccagcctgggcaacagagcaagactgtctcaaaaaaaaaaaaaaaaagtacgttgacagatgtggtaggtacattttctagaaattctccccatgattccaggtcccaatccccaggacctgtgaaggtaattgggtatgaaatttgtgattgagtcttgactcatacattgagtcttgttacagctgtgttacttcataacacagttgtaaaggtaagctatcagggtatcgagtagcctaatctaaacacatgggcccttaaagtagagaattttctccaactgctggcagaagaagagggcagacgggaatgtcagagacattcaaaacgcaaggcggctttgattcaccaccattcctagctttgaagatgaaggggaccacatgaaaactgtggatggcctctacaagctgagggaggctgtcagctgccagtcagaaaaggaagggggacctcagtcctacaactgcaagaaatgaagtctgccaacaacttaaatgaactttaggttgaagcagattctcccccaaagcctcttgaaaagagctcagccagccaacatcttgtgaaactcagcagaaaatctagccacgtccacccagaattatggcctacacaactgtgaggtactaaatgagtgttcttacaaactgcttagtttatggtaatttgttacacatccatggcaaactaatacagtggatcaacagagtaccaatgtggaatccccattaattcttatctttcttcttcccatgatcacatgagtgagctacacagatgttgtatataaagcaaacatgaagatgtctatgacaagcgatgggcattgcaaattcagggatttccccaacacagacagaaagtctatggatttaatgattgttgcatatgtgatacaggttttattattgcttcaaaacattatgtttcattatggaagggggttgggctgtaatcctggctggaggatatatgaactaagaaaatattactacatagatgattgggggaatatgtgagaaatgaatacatgatatatgtgcacaatttcaactttatttttactgcagcagataatgataagatgtattttcactgagcctgcagaatttaaagggcttgtccagggagatttttgaatgtacaggtttggaaagttttcagaaaatgaatagagaaacttatctatggatgtcctttattgtccaatcttccgtcattgaaaataaccctttgtcaggcactggtgataactatcaaattgttagtcattctgtagccccactaaagtagaaaatctttctgctctcagatgctgcatctctctaatagtagcagcctaaccttgcaccttgacatgaatcaacttgtggctggctttaaaatacttaagcaaatgcttatttgcattgaatttttcatttctttatactatatctccttgttgttcataaagtcacatgctttaaaactttggtttgaatggaaaagaaacttaaagatacaaagagctgaggatgatccctaacccacaaaataagaattttccatctctgccattcattgtgtcattttgtcatattctctctctctgtctctctttctctctctcacccctcactcctttcctccttccttccctcttcagcctcctcccttgcccctgttttaaatatgtattcctatcccattgtaatgccaaaatgctttagactgagcacaaccctcacttgagctttttcccttttatcagctaagcttggaatttttcaaaggttagatatgattacttactgtgaaatactaagacagaccttctggcaattgttctttcatccaaatgaagggttgaactttcaaacagttcatttactaggtactgcacctattcaaatgagcctgcattaatacaaaaatttttgaaacaaagttgttgagattgtttgaaaaatggtcaggcgcggtggctcacacctgtaatcccagcactttgggaggccgaggcaggcagatcacctgaggtcgggagtttgagaccagactgaccaacatggagaaaccacgtctctactaaaaatacccaaaaaactagctgggcgtggtggcaggtgcttgtaatctcagctactcgggaggctgaggcaggagaatcacttgaacttggaaggcagaggttgcggtgagctgagatcgcaccattgcactccagcctaggcaacaagcaaaactccttctaaaaaaaaaagaaaaaaaaagaaaaaaaaagaaagataacccattccacaagaagaagatcagtttccttacaagcagattattgttttagtcacaaatttatacctaggcttaacttctttctatgttttagctttatctttattcttctatccttcctctgctgtgctggtgctgtggtagaaattatctagaggaagacctgtatagggcagcggcagggcctggcttaagatgagacctggagagtattgctaataattacaatgggaaatggaaaggctatcttagaatattttatgtgctattcattgtcatcctaggtgcactggctgagcgccatcaattatacacattaatgcaattagtcaagatacagaagcttgtattccaaatgaaaatttcctacatctgaggcatctgtgtaaaaggtaagatgtgctacatttccaaaactgtgtctaaaattctatttacaatgggttacgaactcaatacccctagaggcaaggcaggtagacaatgaggaaatggtgataactatgataaattgggtgtgtctgccctatctttttgtcttgttttgttttgagatagagtctccctctgttgcccaggctggagtgcagtggcgcaatcttggctcgctgcaaactctgcctgccaggttcaagcgattctcctgcctcagcctccttgaatagctgggactacaggcgtgcgccaccatgcccagctaatttttttttgtatttttagtagagatgaggtttcaccatgttggccaggcaggtctcgaactcttgacctaaggtgatccgcccgcctcagcctcctaaaatgctgggattataggtgtgagccacctcacctggctgtgtccaccctatcttaaggagagagccattctccaacctctgccttttgttgccacacagattctgagaccactgttgcctgatcctgattcttgaaagaggaagcagaaacatggattattttatttgaattcccctatatgtaaatgcttattcctttttcatacaaatgaaacataatagacaagacaaacaaaacactcctataggctggatttagccactggatcattaatatcaaggtgaccattaaaatcaagggttcccatgggagacggaacttgcagtgagccgagatcgcgccactgcactccagcctgggcgacagagcaagactccatctaaaaaaaaaaaaaaaaaatcaagggttcccagtgatctcgtttcccacattggttctctctcttttactaggtatacatgtttagtatacagacaagtattttcagttagggataggtgtgtatgtatatatatatatatatatatgtatataatttgtgcaaggatgttatcttttgcatgaaaatcaatctaggtgtatgaactgggcctgtaaaatttattggaagtcagtaataaataaatatgaccactgtgtttattttactgtcttctgattaaattttgtgttgactctggggtaaattatctgatatgctgcaatgggatatttccaggagacttatttggaaaacctgattagaacccagtagagggtaaatgacagagtccagtgaaagaaatcattcttggaggcagttgttttcactcttcatgactatttctagaaataagctttagggaaggatgttgcctaactagggcttactgtagagggattttcctgttcctactggcaatttatgtagttactatgaatcagtggtagaattagatgcatttgttgactgaatcaattggagtttctgtttgttttaaatcaggcatacaatatatcatgccttacaatgacaattaaatacagatttagaatcactggattattaaatgtaagtgtcataaggacaagtaaaatgcatcgacttcagggattccctgccagaaagtcatgcttactggattcattgcacagccgtatctgggacccgctccccaccacatccagcttgtgcagggacaatcccagaaagaaatgtaaagtggctgattacaattttggagtgtatttcctgagaccccttacccctttctgaccttgtaattcatcattgacgttaacataataatgatgattgaggtaataaagcctagatctttaacatatgaagttcagagaccatagcagaggctgctggtgccctaccatcccttccgtgttcacccggacatgcaaaaggctgcttgctgcaaaaacctgctactattactctctgtctgagggctttttttcccctgtggtcaaagaggcaagctctccttgtgtctaggataaggtccccagaagtagcctttaaccaatgactgatgggaagttgatggataaaaacaccccaacttctttgactgtcaaattatgtatctctaagacgtgactttgcatttccagcaagttcccatgtgatgcttatcctgctggccagggactacactgtgagagccactgtactaaagacattgaaccacatcaaggactgaagcattttaggatttgatcacgtgttcttttcatagaataattttctaaaatctatttttacttatgcctcctacccacggaagtcaattacttgaaataacttgtagggaaaaaaaaacttttcatttatattttatcttagccattcccttactgtgattttgattttcttgctgtcagggttaaccgttttggtaggcctaaactaccattaaaagtcgttagtggtataaattttctaataattcagaaaaattctattgtattatttgtgaatctaattgagttaatgagttttattctacaaataatatttataataataggtctttcataaacataagcacaaattctttcattagtacatttttcctgtatgtcaacattttaaataaagtacatatgtgaattttatggcattttttcatttgtgatcatatatttctttaagggaaatagcacatcacttcagattcctgttaattttacctgctgtcatctcctacttaaatgagtcatgtcaagtattacgtgctgcttctcctgacaagtacctgaaagttggagcaattttcacacactctgtcctattcttctgtcatagttcttcaatgcattatgggcaggaaatgactttgactgatgagaagagttagtgggaggatgttcaaatcaaatggcacttatccttgccctccacccccttatctctaagaactccccacagatggcttacgttgtcctgggctggtttatggtatagcaccattctctgctaagctcttgaacaccagctcatctgcttaattccaggtcttctctatccgttctgggctctcctatcctcttccccattgctgtgcttcacttctcccttttttcaaataaaactaacatatggcttttgtgtgtggccgatttctaaatcttggaaataacagggaagggaaaaaatggtgacaacccagcccagtaccacaaacttacaacagaatatcatgccaccatgttctcagttctttagctatgcccgatcacagagaatttctcctcaggcctccatattgcttatatctttgcctcttcctctttctgtcccctgctttcatcccttcctcccttcttgctggcctcccttctggccaccttagtctctcttactctgtttcatggtgtaatttggctctcattcatttaaaatttgagcaagggtcctcacatttctctatgaacaagtcagtcaaggcccatcatcaaagtatttttctaaacaaaagagctatctacctctgagaagatttgaatcattcccctagagaggatgaagtgaccatagtcagtattgttttaagtaccattttaaattctcactacatttgttaaagggaagacaatagggaggcttactgctgagagtatttttgtgaattgacacaggtttggaaaggaaaactaaggtgaattaggaagtgcattgctggcttatgttaaagaagaaaatgtttaaggactcttgctaaagatggtaatgaaggctttatttggggagactattggctataggtagaggaaccactgcaatgaggtcttgaaatgggggaaggagactgggcttaactctgactccaataaggccaagtggggatttacaaccaaggagcaggttgagggtcagtgggtggaaaattactaaaaggaaacctcagggtaagggtgactcttactagaccaactcaacataactcctgctgaaggctggccagggtgatttgatatcgaggatgggggatgagaaatttgattatacaaagtgtgggggattttcagtaaactaacttagccccattcttgcttatacttgattctacagggacaaagaggggagcccaaggtcggaactaggttaaaggagggagtctttgttacttagaagtcagattcctcgttttagctctgcttctgtctggcagtgtggtctttaacaagccacttaatgtctcccagcctgtgtttcatttgtaaatcgagagaatttgttctgtgtctttcaagctgaagcataagcctaaacaaaacaaacaaaaattcaccatggctcctgttgaagcaagggaggagtccagacctacccctttatttttttctctcccatggcctcatcggcagagttctgaacacactaatctagatgattttcataaacaattgttccctgcttttctggagctttttatcaaaattcagtttactataaatgctccttatatgtcaagcagaagcctctcaggtggaagcctgagaaaggaacttcccatggcctgacatagctgaggaattttggagcatagtcgtttcatgtttatttatggattgtttatggccctaggctaagctataaccaaatcttcttactcaccatcctatgtattcttaatatttaaaagtctatcacaggtctggtctgttttggaaatgatgtacctgttgaaaaagatttttttttttctgggaaaagagtctgggggcattttgattgagatttgacatttggcaataattgatgagtatgttttttatcttaaaatgcctgtgtaattgataatatacttaaagaaatctattacattagcaggtgattccatgaagaaggcagaaatcacttaaacctctatagcaggaatttgtgacataccacaaaactgccccaaccccttgggaacttgatttccattcacttgtggagatgagtcccctgcacttgccagacacccatgccaagtgggcagtggggcaaaaaatggagggtcattccatgaatgcgggcacaactgaaagtaagttaacacctccagagacaatccttagccaatggtgagtaggagtaggtagaataatgccccagccactcctacctttgatggtataattttgaagagcattgtgtgcagttcttcacagtatccttaaggagactgagtctcatttttctatagaagtagaatacatttgattttttcttcctttctctgtctcactttctctatctctcacttttgcatcctgggattacctcataaatacttatctgcctccaagtccttgcctcagggtctacttttgggggaacccaaattaaactaacttccaaagctggtacaacttcctatactaataattaaatagatggtcgactgatttcaaagcaaagcttttgcattctgcaactactcttaactttacatatatgttattgtttcaataaattgtactgtgttcttgagaatacaatctgaagcaaagcagagatataggtatagtaattctatttttacaagaattataaattgagataactgtgaattatatgattttagaatttaccttttcagctttcatggagcaagtttgttgagggtttttaattcagtaagaagaaaaatatgatgtggttttatttttttctgttaactgtcccccaactgtgtcaacacccctttcccaaagatttgatactaactttatgacatcttagtcagatttcatgactctcatcttactttgtattcctggaaataatcattttatttcagaaaattattttctcctcagtgggatgggagggaataatcagtctccatgaacagcgcccaaaagactggtgacttttccaccttctgcatagttctccagtcttgatgggaaagcagggtggtgttggttgatgataagggtgacactgtcctggcaccttccaatagacctgatctccactgttggtggctcactgaagactcaatgaacttagagcgtgtcttcaaattgggccttaaaattccatctgcatcctgttgtggtatgtttacttaatcttaacagtaaacaaatttgtacttcctgagttcgcatcagcaagtctgttgttagaagtcagtttgagttttagaaatttattaggtatgatttactcatgagtaaatgagagttggctaaaacaggtggaatgacaaaatcagaagcatcaaaaatcatggctacagtcaccttatgactatccagaattagaaggctctatgcagagatttgagaaatggcaacaaatgaaagtgccagcatctgtagttcagcatttgtagctgtggagtatgtagattcacttttacctgacagtcctctgcaagaaccattttaaaatgcttggaattgtatgttaataattatacaatgttctagattgcaacatggggatctgctattgttcatgaaaacttttatttcttgttctttttacctgggtttctatttcaatttataccttgcattaaaaagaataacattgaaaaatataaaccagagacataggaaaaccaacggaagtgctttaaattacttctctttaatcacttttgtatccagctgcttttatgtgtggaacctattattttacagagtatttcaatattctttatgattgaaaaagaatgacaaaatggtatatgcttttggtaaggtgctttggctatactacagtctttgatactacttggcactatttctaagcctgcatagattcttttaccacaaaaagaatatgtaaatagattcataaaattcatcatgagtttcaagctccatttggaatagaagctgaatatgcacatcctttggaaattctaattcttggaactggatttttcattggaatcatgcttttgtgttaccatgtaattaattcttctttggacatgggtgacaatttatttgatagaaactattgatgcccatcgtggttatgatattcctctcaaacctttaaatctcatccttttctatgctggttctcagcatcatgatttacaccacataaacttcatcagaaagtatgcttctacattttcatggtggaatacaatttttcgaacacactttcagtttaatgtttatagtgaaaatatgaagaagtttgagaaaaagctgaataaatatctcatataaacctttctgaagatatacattttcctgaattgaaactagtagctaacattgcttctggggagcagaaataagcatgtgtcttggttgctaagtgataaaaggaatattgataacctctaattatcttcctagtggagactttttctactttacacacagattccgtatatgtaggaatacatggataataagtatttcctgcaaaactggtcccctcttcatcacctcattgccttactctctctcttgccccactttcttctctccctcatttcctcctctccttaaactttcctctttcattcactgtcccttatttctccctcacttctgaggggccaaattgattgtcttcatattataaggctcacccttttcttgataatctctggtcaatcagcttcattcagtgattgctttgtgaacattcctgtgcatcataagacatttcctatttccatctgatatggtttggctctgtgtccctaccaaaatctcacctcaaattgtaatccccacgtgtcggaggagggacatggtgggaggtgattggatcatggcggaagtttccctcatgctgttctcgtgatattgagtgagttctcacaagaactgatggtttaaaaggatgtggctttctttgctctctctatctctcctgccaccatgtaagacatgccttgcttccccttcaccctctgccatgattgtaagtttcctgatgcctccccagccatgcggaactgtgagtcatgtaaacctctttcctttataaattacacagtctcaggtacttctttatagcagtgtgaaaatggactaatacaccatcagaaaactgatatcattttagctaagatttacatctttttgggcgctgtgttctggccactctttctctgttgggtaaaagaaatagaaactgcatagatttggcagacagactttggtgtagatcctaattttcccactttgtaagtttggctaagctagttatttttttccatattcagtttcctcacattaagtgaggctaataatagccaccttgaaggatttttgtgagattaaataagatgaactatttgattatttgttaacatcttaatttgaaaacattttctcctgtgcctccccaactccatttcatatttcttttcctgatgtttttatacatttccaaacaaaaccaaagtaccaaatgactcagtcaatttaagcccaaatacacagagttccaaatcttcttcatagcttcattgtttcagtatgagaatatttcttaagtgggcaaattctactccaggaggcttcagaatggtcaggaactttttttcttattttcttacacttatttcatttagatcctgcataattcctcccaagtttatcctattaccaagcagtctaatggacaataatgacagggaaccttatataacagagtagtaaaggttaatgacaacaagaggtataacatgagctgcttttatttactaggaatattagttgttctagaatttaaagtccaaaagcatcactggaatcaattttctaagcattagttttatgttttatttttaaaaataaaaaagcatatatcatttcaaggaatattattatatgttattataaaattatatattatattatgaaatcatttacataatttttgcttaaattattttttgcaactttattgaagtatagatgatggttagaatttatatatttacatatatttttatatatatttagagtatacaacttgatgatttgatatatgtatacattgccactttccccatctgccaccacctccccgcctcagcctctggtaactaccaagctactttctatgttcaactgttttagattccacatataagtgagatcatggatgtttgcctttctaggcctggcttatgtcacttaacataatgttctccaggttcctccatattgtcacaaatgacaggatttccttcttttttatggctgaatagtattccattttgtttatgtaccacattttttaaattcatccattgacagacacttagtttcgctattgtgaataatgctgcagtgaacataggaatacagatatctaagggggagagattttaaaacaaactgagcctcaatttgttgctatttcttttctgtatgtaaactctaaaggttcctattcaatttcagtcatgttatctgatatggtagccattcacattggaatctaaaaatcatttccaacccgtttcttctcttgtccacctctaccatggaggctgaaaaaacctgagactcactttcctattctcccctgccaatgagatataagggaagttattatggggcttcatggaaagtttgtactttctaataaaaggaacaaggtacataaatggcttgtctcagtctaatttctatgaattcctgcctttaaatgctactttgttattgtgatacttgcagctaggaagagcatcttgaaaccatgaagcaaccattcaaagaacaaaatcccatatgctaaggatggtcaaacataacagcagaaaaagcctatgtccttcatgacatgggtgagccaccaaaccaacctgacattgaggtacctccaatggtttatatcattgcagtttgtttattattgttgttgttattcatattgctattgcttgctgcccaaagcattcctcattgattaaatctggaaagagtaagctatcatgccattagtgcttccaccttaatcagcttaatttcttacacctcacaagatctgagaagaacaggtacattttgattgtggttagagggtagaacatgaaaaaaggaaaaaataaataatgttcaccataatgagggaagcttatttggcaccaaggaagacaaaaaaggaaaatatacactagttagggaaaataaaaggaaatgtagagtacatgttttgcccttttagttgcacctgggtgcccagttgaccctgggtacaacatttaaaaaaagttgtgtttaatttgtaattatatgctgtttaacattataattgcatgtgaaccatgacaaattattaattccactctagatctctcctgtcatatagacagtggtttgaatgcttaggacatggaaatcaatttcttgactggtctaaggtacacatcattagaaaagaatacctgttgcaaaaaatttttaaatgtgagtgatttgtatcctttgttgttttggactattcatgctcccagcccttttccgtattttatgaagtctttaatcaatacctatttaaatctttgaggaatgccatcatgatcaaattggaacttcaagaagtttgaaagattttctctcaatagattgagtcactgcctttcacctgttttcctacttaaggaaatataaattatgtatttaaacatcctcttgctcttagatatggtatatatgcttctgggaccctttctgttggcacctgttcctctactctacagtatttctcacttagaggaaacctaataaatgtatatctaaaagatattgctctattgtgcatatatattttatgaaataattatttgctgaaagtattttcagaagagctgttttaggtaggaagattttcaaataccatttgataacttatatgtgaattactacctttcagaaataataactgtaaagcaggatatatctttatttacttttacttttccgaaggtttgatatatgctttcagtcttcagaacctgtacttggaattctgtttataaccgagaagtatgcaatgctttcctatttaagaaactcaaaccagcgtattgcttttttggtggctttaatattggttgaaattacctttaatgtatgatgtatattcagttggttgttatagaaaatattattcattaacagttttattataaaagacagtaattgaaaatacaccaaatattgatttttgaccaaattaaataagttctttttctgagagcttttcaggctatgaaagtataaagatgtttggaaacatatcttgatatgtgttcattttaaggtatactgaagtttttcaattgttaatcagtgcagcacatgatgggtgttatccatccaacatgtaatacaattttacttttatagcaattaccgaaattgactgaagagcctgagtagaacaataatcatggaagaaattggaatatgtgtaaattgatctgatctgaagggcagaaagacttacgaggaataaaaaaaaaaaagttatggatccataaagtaaaagaatttttttttcaaagtttagttcactattatataccaaagaaaagtgccatctgactaagaagccctgttctattaaattcttactaaatatctgtttctatgtggaaataaatgctaaactccattatcttgctttcatattactaacattagatttgttaaaagatcctcggtaaataagtgaattgatttcaatggtgattttttgaatcacatgtattaatagcaagaaaaatatattatttgggattaggaacagaaaatatcaaaagcattttaataaacggtataaatatgttttatgagtttttttaaaaaaatcagtcattcattcatttactcactaagtatttactaagcatgccgtatgtgtcaggttctgccctagggtggcggattccaattaaagcatgagtaagacagtctcacctcaaaaagacagtaggagagatagactgataggtcattatactgtggtaagtacatataaatatgtacagcaaattgtgaggagcaaggaggagaaaaccataaactgggttaaggagaggcccagggattgctttctggagaggttttgaggaactacaagcagtgttgctgtagtaaaaattgtaaggcaggagtggtgagggatgagtctaaagagttagctagggccagaccttgagggtcttgcttggaagttagactttattctgtggatggtggaaacccattaaagaagttttaacaaagtggagaaggaatacaatggggagaaatggtcaaatttccttagagaaaggtcctttggtggatacatggatcatattcttgaggaggatgggctagacacaaggagaccaggcaaatctattgcagtaatccaggatcaaagatatgagggtttgaatcagagcagtggcaaaagaaatacagagggggctctgaattcaagaaatgtttggaatatagatttgtaagatctaggaattgttggaatgtaaaggtcagggtgaggagggaaaatcaaggatatctttaggcttctcttttgggtgaattcagtattactaactaaaatagagaggggagttatgtcaataagctattgttccattaaaaagtacaggaaaattaactggcttaaaacaacaataatttattcttcttcacgcttctgctacttgattgagagttaactcttctgcacttgggtttgtctagccctgggtttgtctgcacttagctccagatggtagacagggtccaatttttgctgaccttactcttgtctttattagacttatgggctagccaagaaatgttctttccatgacaaggtcaaaagcacaagaactgaagttgccaaactcctacttgagttacacctgtggttatactgaccgaagcaaatcacgtggataagcccaaagtcaaagggtagggaagtatactccatctctagtggaaggaacttcaatgtcattagcaaaggtaactggggtaaggagagggccagggattgctttctggagaggacactaagaggatggacactaggagggatgaagaatttgggccaataattcaacacccttattgttattgtgagtgatagatttgaggggaagaagactggaggttaagaggctatttcaaagatggtaaaagtccagagcagtggcagctggaaaagagagaaaatgatagattcaagaagtattcaaggcctggacattgttataacatggaggacagatttaggggaaagagtcaaggatgactctaggcttccaatttgactgactgagatatggaaagaaggatagtgggttcagtgtaggaaacattgagtctgagagagagtgacaaagaattttatcgtcaaaaccagggcacttcagagaacgtgaaagagtgctattaataattacgccagaaccaccagggtaaacatgtcttgggactgatctcaggaaaacgagtttatattcactctggagcgagttgcctttgggtaatcaaagtgaagttattgagcatcagagaaagactctgtctaaaaaataaataaattaatttaaaaaagtgaaattatttagtataatgttgatatttgagtatgaaattcagtggagagaactggtctggtgatatagacttgggagttatcattcatagtttaaagtttgaaagcatgagtctggttgaaatcatcaaaggaagcatatgcaggatgaaatgaatataatagaatgagaagatgttgctggagtagatgacagatgaggaacttgagaaggaaaagtcaacaaataagaatttgatttaagccaaagagtagaatttaatggacaaaataatcatatgagaacactcagggtcagagctggctttgagtatgactaaagttagaaattttaacaccatctttttttccctcagactctctgtttttttgttttgttttgtttttaagctgagtgactctttgaggctagagtcatgatcttaggcagttccagattcatattctattagctccaaaaccagaaaaaaaaaggagttttttccttgttatctcaaaatacaaaataaacctgagggaagactctaattggtcaggtataagtcacatgcccatccctctactaatcaccatggctagagagttggggacccccacattagtgaagatgcaggagagcagtgggggtaaaagtcagattacagcaacttgagaagtgactgagaggtggtttggatgcagcaagtacagataagcattttaataaatttattataataaatatgaagaagagacaaactatacagtagactacatgaagggcaatgcgtatgtattttagatttgtttataggctgagataaaggaatcagtgaaacttgagatattcaagttaaagaaaaaaagagaatgcttgttggaacaagatcatggagcaagtctgaggagatgagatttaggacaaaaaaatgaaagaatgtagatttgaaaagggaaaagaacatctagtcctctgaacctatgatgaggtacagctaagtgtggacatcagtaagttaatggaagggcagtatattgagagagccaaggctaagagggagggcatcagggcctgagtaatttcagaagagcattgaaaagtcattgagggcactggcttcaggaactgactgaaggtaaggaaaagaattcacaggtgattaggcttagctgatttgtggaccacgagtttgtcttctcacccagtctgtagggctgtgtgatttttctctagctgtcctggatatgggcatgaagaaggtaaattgatctagggttggtgctttgatgagttcacgtaaatggggacaagatgctctcctcaaggaaacatacagctttagaggcaaatacaaggtcttaaagataagtaagcaagaacaagaagggaactttacttatttctggcattctgacatggtaatggtagacctctctatgaaataacatttctaattgacctttgctttcaatttctgttgtgatgagaagtttataactcttggaccatgctggagtaaatcaaaacataacagatgtttcacaatttgcaaaactgatttaattgtgttttatgttgtattatatttctgatagttataactttcctccccatctttcaccacacacgtacgcacacacatacacgcacaaatggacatatagcaacatcgtgtgcaaagctcttttggtgtcactatgaagctatggtgagttaacataatcagaacataatttcaggtctctaagtttcaattccagtatgccatatgaagaaaaaatattatcaaaaatagaacaacttttatataacttttatttaatgataccaaaattcttagaggtcattgcaacaaagtcttatcaatagcaggaaatattttgcagcatactgtaaagaacactggatctttttaccactaacgagatacgagatccagggcaaatgagttttctcatatctgtaaaattagggttatggtcccttcttgtatacctcacaatgtggttataaaaaaatcagagaggatgtggcaaaaagtgttttataaataataaatgagattataatttattgatcaatttttttaacattacatttatattcatttggtaccacagcatggattatttaaaaactgatgattacacattggtctctttccagggaacttagaggaatggtttaaattggttgcctattatatgtaagtttgtttaaaaatatctaaattatttatgcttctttcaatttatgtaatagattttaagagtccaaagatgatgactcaaactatttactttgttttactgtgtttgcaaaatgagtgaggtaaaagactggaattatctgccaacatcgtctgtattgtgttatgctagaaacatataattagatgaacattttttacttatttttgttcttaaggttaagagacgacagccttttctgactggggaaaatgctcacatctttttagttgagactcacccttatgtagcaatacactggccgggaaatgtaaagaaagttctaggttttaagtaattaaatttatgattatctttccctaaaggactctgtgaattggctcaatagctatttcctacctcaggattcaagttccatgttgggctttggtaaggactccttcactcctacttctagactgagtcccaagcttccaacctgagcatttgtatcatctggggcttcttaggcatcaccacaaagtgatcatgagaggaacaggagacaaatgcagaccttagtcatttacttatggcctgttttccatggtggaccaagttgaaattgaacacacccatatacaaacatccatactgtattgattctcctaagccaactctactggttgaactgtgtgggaaagatacaaaatgtaactacatggactaatcttgcaattccaagctaaacaattatttagcatatagtctcagtttaagatgcaaaagcagaaactattgtggccagagattttagaattctacatctatacttgtacttcactttgcctagttgctggttcttgtctatgctcagtgtaatttggggcactttactgaaaaatctgtacttaaatcaagtcatttaattaattagataattaatttagttcatttttattttggtgagaacatttaacatgagatctaccctctctacaaatttttaaatgtacaatgaagtgttatttactataggcacaacgttgtacagcagatttctagaacttaatcatcttgcataagtgaaactttgtaccgattgaatagcaagtgcccatttccccctgccagtccctggcaactgccactctaatttctgcttctgtgatttcactatttcagatactttatataagtaaaataatgcattatttgttcttctataactggcttattccacttagcataacgtccacaaagttcatctatgttatctcatgtggcaggatttcatgattttttaataatgaataatattcaattgtatttatataccgtattttttatctatttatctctagttggacatttaggttgtttacatatcatggctattgtgaataatgctgctatgagcatgggagcgcagatatgccttcgggatccatatttctatttaataccagtaaatacccagaagtgggattgctggatcatttggtaattctattttaaattttctgaggaacctccgtattgttttttatagcagatccaccattctacagtcccactaacactgtaccagggttgcaatttcatcacatcttcaccaacacttgatatctttcctttttatcttagccattctaagaggtatgaggtgatatctcattgtggttttgatttacatttccctgattattagtgatgctgaacatctttttatatgcctcatggccattcgtatgtcttgttgggagaaacgtcgattcacagtttttgctcactttttaaatttggttgtttttctgctactgagctgtaggaaacctttatatatttgtatattcgccccttatcagatatatagttcgcaattttttttctcattctgtaggttgccttttatctgttgtttccttttctgtgtagaagctttttggtttgatatagtcccctttgtctattttttgcttttgttgcctgtgcttttgaggctacagccaagaaatcattgccaagaaccaacattatgaagctttccctgctgtgttttctgctaagagttttaaagttcaggtcttacacttaagtctttaactcatttttagtgaatttttgtgtgtggtgtatggcatgggtagaatttcatacttttgcaagtgaatgtccaatcttcccagcatcatttactgagaggactctttcccagttgagtgttcttggcacccttcgtgaaggtctgttgactacatgtatgggtttaattctgggctttccattctgttccattggttgtataggtctgtctttatgccagtatcatactactgggttactgtagttttgtaatacattttgaaatagtgaagtatgatgcctctaactttttttaaacaagattgttttggctattctgggtattttgtggttccatatgattttaggattttttctatttctgtaaataatgccatttgaattttgatagaaatttcactgaatctgtagattgctttaggtagtataggtattttaacaatatcaactcttagtcaattttctgttgctatcacagaataccatagactgtgactgggcgtggtggctcacgcctgtaatcccagcactttgggaggccaatgcaggcagatcacttgaggtcaggagatcgagaccagcctggccaacatggtgaaacctcggatctactaaaaatacaaaaattagccaggtggagtagtgggcacctgtaatcccagctactcaggaggctggggcaggataattgcttgagcctgggaggcgaaggttacagtgagctgagatcgtgccactgcactacaacctgggcaacagaatgagactccatctcaaaaaaaaaaaaacaaaaaaaacccagactgtgtaatttataaagtttatttacctcatagttctagaggttaggaagtctgagagcatggtaccagcatctgctaatagccttctggctgtgtcataatatggtggaggacatcttatggcaagagggaagagtgtgtcagctcagatcactcttcctcttctcatagagcctccagtaccatcatgggggccctagcttgatgaccttatttaattctaattacctttcaaagaccccatctccaaatcccattaacatatggatttggggattaagtttccaacacacacacgacatttaggggacaccatcgaaccatagcattctgcccctggcccccaaattttattttcttttcacatgcaaaatgtattaattccattccagtagccccagagtcgtaacttgtttcaggatcaactcagaagtccaaagtccagagtctcatctgaatcagatatagatgagactcaaaatgtgcaatttccttgccagctgcaagcccgtgagatcaaaacaagctatgtatttgcaaaatgcaatgctaagcacaggatagtcattcctattaaagatggagaaaataagcaagaaaaaataagtagctggtcttagcacgtcaaaaccccaacagggaaacaacattaaaccttaaagcttagaatgatctttcactccatgtgccatctctggaatgtactggcgtgggagggggggttggaatcttcaaagccttgggcagttccatccctgtggctttgctgtgctcagcccatgcagcagtttatacaggttggagtcttatgcctgcagttctcccaaggggactgaatacttgtagatctacaattctgaattcttgtgggtagtccttcccctgcagctccactaggcattgccctagtggggactctccgtgacagctctagcactgactgaggtgtggctcctcacaagagggcattagctatggggatctgcccgcagaccctgacctaaacgacggatgaataaaacgtacactgacacacagatattctgttttgccagtcctgctgactgtccgaccacctgcacaccaagagaggtttgtcattgcggccggccctgagcagctcgcactccaggcatttatttagtacagaattaacaacagaagctttgagtaaacacacttgtggataattaacatggttaagagagtagttctactaatgattaaagctcaggtaccgcggtttaaagtaaataccattagggggcaatagccttggtcaaccttcccccatgagggccatctggctcaaaggttagttattggaggtagggtaaacagacttaaatgaggaagactctgttgtccctagtatttaccttatgacctaattctctaatgtaagaaccggctgccttcagcctgttcaattattacaagctatgtaagctttcggccttccaaacggtttgtgactattccctataactttccctaatatgtccctttaatatttctgccaccatcctgagtgaatcccaacaactgaccttacatttctgctcagcattgcccttgtagcggctctctgctgtggctctaccctgtgacaactctctgcctgggcctccaggctgttcatgccatcctttgaaatctgggtgaaggatgttcccacagctcttacattctgcacatctccagaattagcacttcatggatgctgccaaagtttatgtctcataccgtttagagtggtaggtcaagttgcacctggagcatcttgtgccacagctgttatgatgaggagtgctgcaccagaatgcaaggaacagagacccaaggcagccctggccagtggcccatccctcaaaaccattctaccctcccagagctctgagcctgtaatgggaggggaagactcgaagatctccaagagtttttctcctgatgtcccgatagtctctggctttgttttatccatactaatctccttatcaattgatcacttagtcacacccttggtttcctgtgctgaaaatgctctttcattctctaccacatgtccaaaatcatttcactctgctttcattttaattacaaattctctcttcaaatcatctctttcctcttttgttttactataagctgttaaaagtagccttgaaacatcctgaatgctttgctgctttcgtatatgttccacaagctattccagttcatcactcttaaattctgccttccataaagcattcaaccatgaacatagttcagccaagatttttgctactttataacaagaatggccttttctccagtttctttagttccatatgatacctcattagagtggcttttactgtccgtatttttatcaatattttggtcaaggccacttaagcaatctctaaaatgttttagaatttctctggtcttctcctttttctgagccctcaccagagtcactgttaatgcaccatttatggcaatgcaggtatttttttttcctagtctgttcctccagattatttttatttatttatttatttatttatttatttatttatttatttatttgagatggagtctcactctgtcgcccaggctggagtgcagtggcgcaatctcggctcactgcaagctccacctcccgggttcacgccattctcctgcctcagcctcctgagtagctgggactacaggcgcctgccaccacgcccagctaatttttttgtatttttagtagagacggggtttcaccgtggtctcgatctcctgacctcatgatccacctgcctcggcctcccaaagtgctgggattacgggtgtgagccaccgcgcccggcctcctccagattcttacagcctctacccatcacccaattccaaagctgtttccatattttcagatctctgttatagcaatggcctcacttcttgttgccaattttctaccttaagtgcattttccattgctatggcagaataccatagactgggtaatttataaagaaaagaagtttatttagttcatggttctggagtctgagaagtccaagagcatggcatcgacatctggcaaggtcctttttgcttcatcataacatggcaaaaagcatcatgtgacaagagggcaaatgtgtgttacctctcttcctctttttttttttttgttaactagtttctaaattgttatttatttttatttgtaacaagccatttacttaagtttatgtaaagggatagtttatgcttaaaggatagcagaggttgttgctgttctatttagcgtatagcaaacatggccagattttacttttgaacttcctggaagctcttcattggaccttgagctaacacaatatatcttttgtcaccaaaagagtattattcttatgtcataatgagaacaataatttacatgctttgcataataaatgcctaaaagacattttattttatgactgcattatttttcttgctataatggggatattgtaaatcatatatttgtataatattgatggtacttatttattttttatatgttactgtatgatgtacattacaaaatcaaagcaatttgtcttgatctcttaatcttaagagtaacactttaactcacttaatctttctaatgcatattacaagtgatgtatacttttttttgaagttacatacttgccaatttaatttcaaagctacaaaccaagctcaagtctcaagtgcagcaaatgcctctgaaatgaggtttctatggattcataaacataaaacaatcagtgcaaaagaataattgaaatgatttgtctcctacttttttttttcttgtcccaagcatttttttttaattatactttaagttctagggtacatgtgcacaatgtgcaggtttgttacatatgtatacatgtgccatgttggtgtgctgcacccattaactcgtcatttacattaggtatatctcctaatgctatccctccccgctcccccgaccccacgacaggccccggtgtgtgatgttccccttcctgtgtccaagtgttctcattgttcatttcctacctatgagtgagaacatgcagtgtttgttttttttgtccctgcgatagtttgctgagaatgatggtttccaacttcatccatgtccctacaaaggacatgaactcatcttttttatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtgtatacccagtaatgggatggctgggtcaaatggtatttctagttctagatccttgaggaatcaccacactgtcttccacaatggttgaactggtttacagtcctatcaacagtgtcaaagtgttcctatttctccacatcctctccagcacctgttgtttcctgactttttaatgatcaccattctaactggtgcaagatggtatctcattgtggttttgattacccctcttcctcttttaataaagcctccagtacaatcagggaggctccactttaatgaccttctctagtcctaattacgtcccaaaggcgccacctccaaatactatcaacatacaaaattggggattaaatttccaacacatgaaattttggggacacattcaaaccatagcaggtaatatggacattttaacaatattcactccttcaatccattaacatgacatgtctttccatttatttgtgtttcctttaatttcttcatctgtgttttgtattttttggtgtataagttttttatttcttagtattttaagtattttaaatgtttatttaaaacttaagtttatttctaagtattttattcaccttgatgctattgtaaatgggattgttttcttaatttccttttcagaaaatatatggttggtatattaatatacaacaaatccttgtatgttgattttgtttttgtttttgtgggtttttttttttttttttgagacggagtctcactctatctcccaggctggagtgcagtggcgtgatctcagctcactgcaacctctgcctcttgggttcaagtgattcgcctgcctcagcctcctgaatagctgggactacaggcatgtgccaacacgcccggcttattttttgtatttttagtagagacggggtttcaccatgttggtcaggctggtgtcggtctcctgacctcatgatccgcctgccccggcttcccaaagtgctgggattaaggtgtgagccaccatactcggccttgattttgtatttttaaactttactaatttttaaattagttctgtttattctggagtatttagggttttctacacggaagatcatgttacctgcaaagagattttatatctttctttcctatttgaatgccttttatttattttccttgcctaattgcttttgctaggattccagtactatgttgaatagaagttgtgagagtgggcattcttgccttgctcctaatcttagaagaaaagccttcagttttttattattgaatgtgatgttagttttgtttattatgttgaggtaatttatccttattcctagtttgttgagtgtttttatcatgatatggggtattacattttgtcaaatgctttttttattacatctgttgagacgatcatgtgatttttatcctttattctgtcaatgcagtgctatgctctgaatgtttgtgtgcctccccctatttctatgttgaaacttaatcaccaatatgatagtatcagaagatagggcctttgggaagcaattaggtcatgagggcagagctcttaggaatggggttagtgcccttacaaaagaggacccaaagagctcccttgccccttccattatgcaaagacacagatagaagacaccatctatgatccagagagcagaccttcactagacaaaaaatctgcctgggccttgatcttgaatttctcaccctctagaactgtgagaaataaatttctgttgtttataagccaaccagcttatgttcttttgttataacagcttgcacagacttaggtaggtggtgtgtatcacatttattgatttgcatatgttgaaccatccttacatcccagggataaatctcacttggtaatggtacgtgattcttttaatgtgctattgaattctgcttgataatattttgttcaggatttttgcatctatattcttcaggaatattggcctgtaattttctttcctttaggtatctttggttttggttatcaggttaatgctggcctcataaaattagttggttaatgttccttcctcttcaatttttcagaagactttgagaattattggtttgaattcttcttcaaatgtttggtagaattcatcagtgaagacatctggtcctgggcttcttgtcattgtcagaatatttttgattactgattcattctcattatcattatatatatatgttatgattttctatttttcatgatccagttttggtaatttgtatgtttctaaaaaaattatccttctagtttatccagtttgtgtaaaattgggtaaggtaatctcttatgtcccttctgattttgtggcaggggttgtcatgtctcctctttaatttctaattttatttatttcagtcttctctcttttttcttagttattctagctaaaggcttgtgaattttatctttccataaaaactctaaatttcatttttttattgttttttgatactcaattttatttgttctctaacctttatttccttctttcttctaacatttgtctcagtttattcttttctagttcctcgaggtgtaaatttaggttgttttcgagaaacctttcatcatttttaatataggaatttattgctgcagactttacttctagtactgcttttgctggaccccatatagtttggcatattgtatttttgttttcatttgtctcaagatttttattttatttttttctgtagacctcctctgtggacatcaagatatttttaaatttcccttttgattcttctttgatccatttgttattcaaaagtgtgttatttagcttccacacatttataaattttccagtttttcttttgctattgattgctagtttcattccattatggttagaaaagatatttggtataatttcaatcttcttaaatttattaaagcttgtttttgggatctaacgtgatctatattgaaatttttctctgtgtgctttagaagaatgtgtacttattactttggggtggaatattctgtatatgactgttaggtccatttgttctatactgttgttcaagtctactcttatgatattgattttttcgtttggatattctatccattattgaaaattgagtattgaatcgcctactattattgtattgctgtctatttttcctttcagttatgtgaatatttgatttttatatttaggagctctgatgttgggtgcatatatatttatagttatatatttctgttgcattggcactattatcattatataatgtcctttttgtctcttgtgacagtttatgacttactattttgtctgatataagtatagctactgttcctctcttgattaccatttgcacagaatatctttttccaatctttcactttcaacctatttgtgtacttaaacctaaaatgagtctattgtggacaatgtatagttggatcttatttttttacccattcagccactcaatgccttattattggggagtttaattcacttacatttaaagcaatttttcttagggaatcatttattattgccattttgtcaatcaatttctgtctgtcttttagttcttttctcccttttttcttctcttgcagttttcctttgtgtttcatagatttttgtattgatccgctttgattcctttctgtctctctctgtctctcttatttttgtttatcttctatagttattttcttgtggttatcataagacatatttaaaatgtcttataggagtctattttaagcagatgaaatgtatatcacgtacaaaaactgcatttttacctctgcttcacacattgttattaatctcacagtttgcgtttttctttttctttttttttttttttttttgagacagagtctcactctgtcacccaggctggagtgcagtggcacgatctcggctcactgcaacctccgcctcccaggatcaagcgattctcctgcctcagcctcctgagtagctggaactacagatgcacgccaccacgtctggctaatttttgtatttttagtggagacagggtttcaccatattggccagcctggtctcgaactcctgaccttgtgatccgcctgccttggcctctcaaagtgctgggattacaggcatgagccaccgcgcccagctccatgaatgtattttatagttacttttaatacttttgtcttttaagttatataatatggttaaaagtgatttacccaccagcattacagtattataatattctgaatttgcctatatatttaccttgaccatcgaattttatgcttctgtatgctttcgttttgctgtttagcaaccttttatttcaatttctgcattttttgtaaggcatgtctagtgttaatgaactcctgaagcttttgtttgtttaggagcatctttatctttcctcacttttgaagaatagttttgctgttatggttgacaaaggggtttttgttgttgttgttttctggagatggagtcttgctctgtcgcccaggctggagtgcagtggtgcgaactcggcttacggcgacctctgcctcccaagttcaagtgattctcctgcctcagcttcccaagtagctgggactacaggcacccgccaccatgactggctaatttttgtatttttagtagagacggggttttaccatgttggccaggctggtctcaaactcctgacctcaaatgatctgcccacctcggcctcccaaagtgctgggattacaggcgtgagccaccatgcctggcctcttttagtacttttattatattattacactcctttctggtatgcaaaatttttgctgataaatcctctgatactctaattgaatttcccttatacatgccaggtcactgttcttctgctactttcaaaatgctctctttgactttaacttttgataattgattataatatatcttagtgtagattttctgcgttcatcttatttggcatttattgggctttctggatctggatgtccattccctttccaagatttatgaagttttggatattatttatttgaatactctttctgtccctttctatatcttttttctttctgatgctcacataatgcatatgttggtttgctttatgttgtctcataagtctcttaagttttattcacttcttttcattctttcttctttttgctactccgacttgttaatttccaataacctgtgtttgagattactgatcctttgtcacgctcctggcttcaagcagtcttccttctttggcctcccaaagtgctaggattataggcatgagtcactgcacctgattttgctcatcctttcttctgcttgatctagtctgcaattgaacctctctagtgaatttttcagttcagttatttattgaattcttcagcttccagatttctgtttggtacttcttatattttctctgttgaaattctcactttatttatgcattcttctcttgacctccttgagcatctttatgatggttattttgatttctatgtaaggtaaatcaaatatctccataccattagggtttctggaaatttatcctgttccttgttctggaatatattttcctgtgtcttcattttccttacatggttttagtttcatagtactagaaaggcgaaaacatcccccagttagatacagtacccattttcataagacatttaggtaaaaggggttacagctaccttacataaagcttgtttaaacatcttacacctgttataattctattaacctgtatgtttttatgttctgatcccaggaagcctttttacccccagaccattttaccttttctggtgaaaagggtttgaaagggggttgggtctgtaagacctatgaggatagcagatttgataaggcttcttaaatagtcctatgattctgtgggaggggcacccatgtaaaaagggcccccttaacccccaaatttaccatgatccagataatagacatattaggtgggaggatatcacagttatcataaatctagtccaacatggcttgcgtatgaaatatattaacggtttcatctggggtacttcacttggtattttatagagagagttgggcagtccccttcttagggcaaatagaccttttaatggcattatctggcccactaggctgatcgctttctcaggaataaccccctgtgcattagtgattgttcagtaatgagctgttggtcctgtattaatccaaacaagcttttaaaatctgtagcatttaaaattaagaattttgttcttaaagtggttatttttacaatccactatagtgaagtttctttaaagaagccgaattataccaatctacaaaatggaacaatttctttatattacaccctttggttttaaatagttaattggttttgcccttccctcatatcgactattttcttggtaaccatagggctcagagttttgttgccctggcttgttctttttaaaatttacttagttttatccgtataagttcctttattataaagcaacttttaaatagatctttaagcaaaaaaacttacttttttgagaattgacatccttttgtttataaaactttaacaaaagcatattttatgcttctcctattttaactttttagtaacctaaatttctaatgggggaaaaaaatccaagggtttaaacaggactttaagatttttaaattactggagagttttcagattaaatttaccaaattaatttttaccaaaaaattaccaaggttatgtaaattagaaggcatctgagctagcttttaccaatctaataagcacttacattttttaagttacttgattagagctctcacatgtagttttgaagtgaaacatcacttccacatgacacatataaagatcgagatataacaggcatgcagaataaaagccatgttcaaaagatacttaatttgcctgttttcgaaaacaatttttctcccttacttagataattagtaaaagttacaggagccaacaaaaggtagaggaaaggaaagagccatcattcaaggcctttccgttttttttgaccgagtcttgctctgtcgcccaggctgcagtgcagtggtgagatctcggctcactgcaatcttcacctcctgggttcaagagattctccaagcctcagcctcctgagtaggtgggatcacaggcacccaccactacagccggctaatttttgtatttttagtagatacaggatttcaccatgttggctagcctggtctcaaactcctgacctcaggtgatccaccagccttggcctcccagtgtgctgggattacaggtgtgagccaaggtgcccagcctggccttttcaaaagagaaagagtggcacttttaagatatcaatctgaagaatgttaaagaaacagattatagaatttaaaagtttaaaaacttcttgcattaaaaataagtcagtatttgtaataaaattttgttttaaccaattatttagttttgtattagtgcatttccttttaatattaaagacccatctctagaaatattattatgatttcattttaattatagccaactgaattatacaacccctttaaaaattcattttgctgaccttactacgacttatgtagttcattcacaacatgtttagactgttttgtcttaaacatccctttttcttgtacaaccccgtcatttttattttagggcaaaaatttaccacacaagattctttcctatataaaattacttttttttaccttttttttttttttaccaaaaatacctctttatatctttaactttctttacatctcttattttctgattcctttaccttgttttttacataacccttaaataagccttgaattagacaaagatattttacctttaataagaatatttttttaaaaaaggttttcctgtaattcttaaattagaattgcccatttaatactaattaataaccttagatcctaaattatgacaagtttgtttaaaagcatttatcctgttacgtttacctgattaatttagtagtttacctagattatttacaaaaactgtgatagccaatatttaaagttatttttctattaaccattcttatagctgtgagtttcaggtatctacttaagtaataaaacttatggttagttttaagggtatttataccaatagctgagtatttagctgttttcatttaagccaaccatatttcataagcatatacaagcaaagatcattctgtcttaggctgggttttatagtttataacccttatggcaaatcttatagtattctgcaggaataaacatgaagctacttgattaatagatgcaaacataatgttaacaattctaaagacattgctgatattattttaccaataattttaacgccaccttatttagtaaagatttcacttaagtcacatgagcttgaaaaagcatttgactagtcttcctttttttctaagtatctgatttgagcactttttaaagccaattaattagagctctttacatatttttagtattgaagatgttgtgtacatacacataaatatatagacgtattaagcatgccaatagaagcacattgcatagacttataaagaccttcttttttttttcatgttttaaaaatcttaccccaggcagttgtcagctaaatagccttacatttgtgtattaaaagcaactcaggtgaaaatcagatagcaaagtttacatcataaggtaagaagagaaagtctggtgtgctagagggaaattaaaaaggattcaattgccaattgaacataaaattatagaagtctattataaaggcctttaaatatacacacacacgcaaagttcccgtagctattacttcagtactttagccatgagacaaatacaactttgccagtttgcaaaacaacaacaacaacaataacaacaacaacaacaacaaaaaaccactgttagatggcagtggtttttatctcagttgaaaagtaacagcagatttaaagcaggcagaaaataaaatagaacccaaaagctctatagtttgcaggtcaaccttaggactctttttccttaatgtaaatgtgcacaaagaccatattacttccattttatataactctggcaagtacaggtgtgataaaacctatggagcgcccagaagggggtcattctccttgttttatctttattccggcttttttttttttcttaaaggaggaactgagctgtgccctaggttcttgtgtggtggatccacgtgtgctgtttgtgggatccatgtgtgctgtttgcgggcaggactctacagtttgtcaccactgagtgtttctgccctcttacgtgtctcagtttctctctccagaggtctatgacctctgaaagggctcaaaacgctgggtaatgagcaattctatgcgtttcctggacgagccattttttaaaattgatttttgttggggatttccctgcagggccgctgcacatctcggggagtcaaccccccagacactcccatgaggctcccggtcacccaagggcacctttcagctgggaggagcaaatgccctttctcttcagagatgaaaaactcagtctctcatttatctaggaaaacaacagctcagttcctcacacaaatgcacacagacaaaccggaataggataaattttagtagaaaaagcaatagagaattccctttagaatgcatctctgaactagaattaggatccttaaacaacaacttcctaggagaaaaccaactcagaataaatcaaggaccatcaaccaaagggaggtccaggactcagaggactcaccagttccactggaggagaagctccaacgcggtggggcttcaatggacccctgctgatacgttagctccggtttcgggcaactccttcggggtcctgagtcttctctgaggccccatatgttttgggagccagattattgttgacgaaaagagtcaaactctgtaaaatattttaagagatttattctgagccaaatatgagtgaccatggcccgtgacacaaccctcaggagctcctgagaacatgtgccccaggtctttggggtacagcttggttttacatattttaggaaggcacgagacatcagtcaaatacatttaagaaatacattggtttggttcagaaaagcgggacaactcgaagcgggggcttccaggctataggtaaatttaaacattttctggttgacaattggttgagtttgtctaaagacctgggatccatagaaaggaatgttcaggttaaagataaagtattgtggagaccaagttttattgtgcagaggaatctctcagatagcagacttcagagacagcatgttgtaaattgtttcctattgcacttaaaaggttgccttgctcttagttgattatctcctggatcgagaaagaaaggaaggaaaacaaagggggaaggggcttctctatagaatgtgggtttttctcacaatagactttgcaggggaatttcaaggtctggcaaggaaatatattttggggttaaatatttttttcattgtctcataatgttatgccagagtcagattgaaaagtaagtcacaatacatagggtcaaataaagctcatctgatgagaatttatggtttgtagggcatgactccctcgaccccttaggtaggaatttgggtaagaaaaaaaatcagagcgtagtcctcaaatgcatcatcagaaaaggtcaccaaattattggagtagcgcactccaaaaccctgttcttccactaaaagaaaaattaagcaaaagtggtcagaatcaactttttcagaactctagaatataatcccaaacttacaatgactaggggaatgtttaatgaaagaagctgctgaagtttgttaagagaactctgatgatttaactcctcacttcccattccccactcccaccagctcagtggtgagtatcataaaaacagcaacccacatacctggtgcagcttgctagtaccagaggagcaatataaaacactttttttttttcttgagacagagtctcccccagtcgcccaggctggagtgcaagtggtgcgatctcggctcactgcaacctctgcctcccgggttcaagtgattctcctgcctcagcctcccgagtagctgggattacaggcacccaccaccatggctggctatttttttttaaaaaatatttgtagtagagataaggtttcaccaagttggccaggctgctcttgaactcctgaactcaggtgatccacccaattgtgcttgtttaaagacttaaaaataaggacaccatgctaagtgaaataagccaaaaacagcaagaagaatactgaataatttcacttatatgtagaatctaaacaagtcaaatacatagaaacagagtaaaatggtagctaccaggggttggtgggtaggagaaacagggagatgttggccaaatggtacaaagttgcagttatataggatttataagtctagagatataatgtacagtatggcaactatagttaataatactgtattgtagactgaaaatttgctaaataaatgtctatcagctaatgaatggataacaaaatgtgttaccatccatacaatgaaatatattctgtcataaaaaggaatggagtgctgatacgtactgcaacatgaatgaaccttgaaaacattatcgtaagtgaataaagccagtcaagaaaaatcacatattatatgactttatatatatgaaatattctcagtaggtaaatagagagaaacaaaactaatggttgccatgggctgggtgaaggtaggtatgggaaatgattgtttgggtagtgagcttccttttgggatgatgaaaaggtcctagacttaggtagtagtgatggttgtacaatattgtaaatgtactaaaggccacagaattgtgcactttaaaatggcaaatttatgttaagtgatttttactacaacaataattttataaaacaatgagaaacagaatgatgaagcaaatgtggtaaagtgttaacatttgggagtcctgtttgaatatgagaactatttgcaattttgcagattttctataaatctgaaatcacttcaaaataaaatgttacaaaaagtttcaagactaatgaatccagataacagattgttgggttattcttaagtaaaagaataggcaactcttccactgaaggtgaagggcagaagggaagtatgtgtgtggatttaattaagtttgtaactggatcaccagggttatagatcatccctgggataggggtggggtcattgttctttctgtgtaatagaaggttagtgcttttgctgaaagagaatgtcttagcattgtaccctcagaagttaatactgagacagggtttgcgtgaacatagtttatttgggtgttacttccaaaaatcaccattagatttatttaggaagttagacaggtaggagaagtaagccaataaaatgtgtactatgtagcaggtttccgctttggccaactgtggctcagtcttgctgggaaatgctgggaaacagagcagaacatacatcagaattactccattttagaagcaagggaactggaatatttcttctccatcttccacctgtcattggctgagagctcctcccagggacattagctttccacgacttccagtcctccccaggccagctgagataaaagattttagttgagaggtatgggtgtttacagtagggtgaagtcagcatgtactggagcagcagggactgaggaaatatttgaaagcattgacagcaccttcaataatgagatagaaaatgaggaaaaacatggtttgaagagagtgatgaggttaaaaaatatatactagttaggagtgggcaaagggatcctctagggaacatgtatattggttgccatgattgccatgcaggcttttgaacctgatgaaagttggtgtccatggatttatcatggcaccaatcctcccatggtcacagagtgggtggagtatagaagctgtggaagcagtcaggaatttgaccttttgtgtttttcttagcaattgtataaacctattagcacatctcactgagacttcggactacgaaaacatttgctcgtatattttcatatgaagtagaatactcttaagctggttctctttcttatacatacttaggatgtgaacctcaatatataagtttatatttatataatcctgttgttttcaggatttccaggctttagatatcggtacattttataaggtcatgaaactaaatcttcgtcagcactggatgaatgtgccaactcagtgcatagtagtgggtactatataaaagtagagtggcctctgccctccaaagctcaaaaacttgcagggggtgagaaacctgtaaatagataagcaggatacagtggattcagtgctgtgatagagatgcataatagatgctcagttaacatttgttgaataactgaatgaaatgtgatccaagatacaatttttcttgttggaatatgcttatctttaagggtgtcatctaagttgacaaaatgttgcaaatggcatgttcttagataaagttagtgactacagacttcaactgttatcaagaaaagatgtaaatatttaccatcacatggtgagaaggttttcttaactcttgcataagcagactagggaaaacagaagaaaacactgtgacccataattttccaaatttgttttcatgggaggggagaatgagacacatgagtcattttcacttctgttagctgatttttctcatgattattaagccacagaggccacattgcttcttctatggtgatcaagtttaacagagaagcatcatgagtcctgaaagaatctcactccatgacgatgaagtgtgtatattctgggaataataatgaactcatctcaccttgacactcataaaagtgaaagcctttagtagctagattttaaatattttacaattgttttattagccatgcaacaatttcttaaaatttattttcatctaacactagagacaaataaagaaaagtcctggccaggcatggtggctcacgcctgtaatcccagcactttggaaggccaaggcgagcagatcaccgaccagccttgccaacatggtgaggccctgtctctactaaaaatacaaaaaaaaaaaaaaaaaagagctaggtgtggtggtgcacaactgtagtcccagctactcgggaggctaaggcaggagaatcgcttgaacccaggaggcagtttgcagtgagcagagattgcaccaccgcactccaacctgggcaacatagcaagactccacctcaaaaaagagaaaaatccttctctatctcaaagaactcacaatcttttgtttactaacatcactttactcttaataagaatttgactttactttgaaaaaattatttatttactcaaccaatattatttagcactgattatattcataagaatgtgctagaaatcaagcacagtagatgaaaaaaggaaggtccctaccatcgaaaagctcagattcttgcagagggagagagacctgtaagcatgcaagaacaatgatttcaatattgttataggccaggaaaagaagagaaaatatctgcctagagaaattagtggagactttaggaggagaagccatcctactcagtactagggatggaaaaaaaacattttgtagacatcaaggagaaagaaggtggcttgggggtaggaaagggaagagggaagtggaagtatgaaaggcgttccaggtaaaggaaacaggagatatacactcagcaattgtgacagagcatagaatgttctggaaatgaatggtcagggggttaaatattggtttgtgtggggaggaggaaatgaggaataatgcaagggaggtaggatagggagaaatggtgaagagtcatatgagatgtattctgtactctactttgtggggtagaagggactgaatgttagggaaatactgttgtgtccaccttaaagatacaggatgaacaaccacccaaatttgatttcggtatggggaccaatgatcacacacacacacacacacacacacacacacacacacacacacacacgaagagggtatgaagatttcttactcacataataaggctttctaggaagagtagggtgactcacaagcagtaaaaatggcttgaagttttatggtggttagtgagtaaggccagggtggttcccatgcacaggaaggggttggtggcggtttgaattttccactggcaccaaaggagagaacacctagactttattgttagcttgatcacttgtaggatagaagaagaaaacggagtgtggctttacagctatcagaaatcaaacatttaaaaaatggagtcagtctctttatttcactagtgcaatcacatttttgaaaattcaaatcaaaaccaaaaagaacccagtaatagtgagaaaataacctggaaaaggatgagaatggaccagagaaaccagcaggaggtcgtggcaaatacctgggcaaacgaaaatgaggtcctgaactatcacactgacaatgaggatggtttggggaatatttctaagaaagaattgagagttggtgcccataatgagtgagagaggctattagatgactttgagatctgattgggcaactggagaaaaaatgacaactaatgataggatatatgggaggaaagacaggtggtgagggggagacaagttattatttcagttttcaacatgtgattgaaacggcttagagccaccttgtcttttgagaaatgaaccgcagtagttccaggctctgtcttttcccagatcaacttatgtgatcacataacctggtcacacatcataatgcttacaaataaagcccctctgtgaatctcaattgagcatgatttaattttcattttctatggaaattttattgtttctttccctattacaaaagcaattcatgttttatataaacaattatgaaatatagacaagtagaaagaggaaaatacaaatgaccttccatgaagaagtgataactaataccattttggtgtattatcttttagagagtaccattggagcccaaatatgagaacaaaataacctagaaaactgagaaaaagcttcaaagatgaaaaaaatgttttatttgggtctttaaggatcttgagtacatttactggctataaaggggagaaggtgaggtgaaaatggaggttcaggagaagaaggaagggtaaacattttaaagctgagattgtgcagtacattctgtattataacataatgattttaacttaatatattatttaacttaatatttaatttaatctattatgaacacaaattgtaagtgaaatttttgcagtgaaatacatacagtgattttgacattttgttttgtaaccaaagagtgtgtgagacaggtctccatcaatttagaagtttattttgccaaagataaggaaatgtccagaagaaaaaacatgaaattacacaaacagtctgtggtctgtgcctttctccaaagatgattttgagggcttcaatatttaaacgggaaaagtgggcgggaggggaaagaaggaggttatagtcacattactgaatccacatgttgcaagagaaaaggagcaggtaggggaaaggttaattatgtattcatctcactttacataagataaggtgaacatagtgtagccgctgtggggatattaaatctttaatatctagctatctgcttctgaacaaaaggaaagacagtttcttgcatgactcagccttcagcttaatttttttccttttggatagtgaattgggttctgagtttttatttttttctttcacagtttgtattatgaataaagcatactagatagactatctttctgactctggaattaaagtaaggaggtttttagatgtgataataaccactctccactttctctctcattctggcaaaatgtctgagggaagatctcactctgcaagtttagctttcatgaaatgttttcaaatggagtgatggctcctcctaactgaagacagatcttcagtcttgtgtttgcttgccactgaattgtgagagtactttttctctgtaatagagtaaatgcttgaccatttctttttttaaattttcttttcttttcttttttttttattatactttaagttctagggtacatgtgcacaatgtgcaggtttgttacatatgtatacatgtgccatgttggtgtgctgcacccattaactcatcatttacattaggtatatctcctaatgctatccctcctccccctaccccacgacaggccccggtgtgttatattccccttcctgtgtccatgtgttctcattgttcaactcccacctatgagtgagaacatgcggtgtttggttttttgttcttgcgagtttgctgagaatgatgccatttcttactgcctaaagaattaaacttcctttgcacctatctataagtaaaattctttcaacttgacttaatttgtcacttttggaaattacataatgaagtgtttttcagaccactggattatgtatcatggaagtgttttcatgcactaaatccatatggtggtttcaattgccaatagaggaaatactctggattccccacgaagtactgggagcctggggttctagtggttccacaattaggtagtgtgcaacagttatctattgccccaataatgctgcgtaataaactggcaagccttagtaaatcaaaaaacaaccagaattctactttcagtataacagtgtgagatgctctgcaaactcaaccacttaaaatctctagaaatgatcctaaaggcgtatagcaagggaataaatgtttaagaaaatctattaaaattggtgggaatagcaaaagtctatggtatttgaactaagacccagcctattcttctccccttcaaacttagtgaaatggaaactccacttaggactggtacagcaaagaacacagggttccttctccctccagtttccattccaagggctacctttaagagaagttcaggacttcagcattttttaacctgcccgcagctacctgttgctaaggctaagttctggacaaggtgaccaagaagtgggggcttgcttcttcatcctagcctccagtatataggatggaatctctaccttaggtgtggcaacattgagtatactgggacctgatcatctttgcatagattctaatccatgtgtgatccacatggagagaggcaagctgagaagaactaatgttactacctatgttcagaagtgttcagctcctatgacagggatgtcactcagagaataatgtgccattatctccattcccagcttgagagccaaggtatagagattattccccggaggagaagcaggccataaaagatagaaccgtgaatctcttccaaaggaactgactttatttgcaagaggaagtggagaaattcaagcctaatggcattctcaaaaacagtggaagttgttttaaaagacagttgagagtagattgctaaattaatcagagatatagacaaaactgtaagccgactgctttgctggagaggagcttggaaaaggacaggtgtgatgagccctactggggacagaacaaattttatttttgttttatttttgagacaaggtcatctaggctagagtgcagtggcgcgatcacagcttaatgcagcctcaacctcctgggcccaaacaatcctccctcctcagcctcctgagcagctgggactacaggtgcatgccaccatgcctagctaatttttgtatttttttgtggagatggggtttctccatgtttcccaggctgctctcaaactcctgagctcaaacgatccaactgcctcagcctccaaaagtgctgggattataggcatgagccaccgcgcccggcctgagagcaaattttaaacattgacctaggtaactaacctgtcaagagagcccagactagattggatcagtctatggagcaatttatgccctatgttagaagcaacagaacaatcagccagtaattagtggaatttaatggctggatgtgatcagggaaagagaaaaagagagctctgcccaaaccaatgtcatcccagggtaactatggtcattcccaagtctgcacctcatgaggagcagcatcaaaggttttatactgcaagagagggagagtgggttgaactacacttcactaaaataatctaaccagtcactaaacaaacaggcagaaaacagtaagtacttagaggggaccaatacccagagttgccacaacatattatctaaaatttctgatttccaacacaaaattgtaagacattcaaagaaacaggaaagtataatccatataccagaaaaaagcaggcaacagaagctgcccatgagagcaacaagacatgtgatgtaacagacaaggactttaaagttgtaattataaatatcttcaaaggactaatggaaactgtgattaaagaagtaaaggaagatatgaaaatgccacatcaaatagagtttactaataaagagatagaaatcataaaaaggaaccaaattgaaattctggatttgagagttataataactgaaatgtaaagttcaatagagggctgactagtatatttgaatggcagaagaaagaacccatgaacttcatgatttgtcaactgagattgcccaatttgaggagcagaaagaaaaaaagaatttaaaaaaattaaagaaagttcttcaggctgaaaacaaatgatcccagatagtaattcacatctatgcaaataatgactaaataagtaagataaacagagcactggtaaaggtaattatgtaattatgaaagagagtgtacatgtattttttcctatcttctcttaactgatttaaaaagcaattgtataaagcaatatgtaaataatgtatgtcatacatgtagtatatagaaatgtaatctatttttccaataataccacaaaaggggatgggtgggagaaaagccatattgggttaaggaagtgactccagatgatagctgaaatccacagaaacaaatgaagagagccataaatgagaaataagaaggttcatataacaaaagctataagtatatgtttgctctttttctctcagcttctttccaatacataaaatatataaaataataattatgtcaatgtattgctgggtttgtagaatttatagatttaatatataataataagaccataaaaatggggaaataaatagaactatatagaaataatgtctctgtatctcaatggaattcagtttctgataagttaacatatgataagccctaaagaaatgactaaggaaataactcaagaaaatatagtgaaaaaataaagaaaattctacagtagaaaatattcatttaatgcaaaaggaagcagtaaagcagtaatataggaacaaaaaggacatgtaagctataaaaaacaaaaagtaaaatggcagaggtaaatctaactatattagtaatagcatcaaatgcaaatggattaaacagtccaaataaaaggcagtttgtcaggctgaattaaaaaacaagatccaacgtgtgttgtctatagaaaacatactttagattcaaagacaaaaattgattgtaagtaaaacaatggcaaaacataatcgtgcaaataaccacaagaaagctggagtggctatattaatgtcatagaaaacatatattaaaataaaaaatgctactagagataaagagggacattttcaaatgataaaagggtcaacccactgggaagatataacgataatgatcatctatacaacagagcaccaaaacatatgaagcaataaatagacaatttaacaataatagagactgaataccacacttccagtaatggagagaagtaggtagaacataaacaataaagaggatatttgaacaccacaaaccaactagacctattaggcttgcatacaacactctacccaacaaagtaggatgtttatttttctcaagtgcacacacaacattctgaatagaccatgtgctaggccataaaataaacctcattaaatttaaaaggatagaaaaaatgtccactgttttttctttccacaatggagtgaaactacaaacaaataacagaaagaaatgtaggaaacccacaaatctgtggaaagtaaacgacacactcctaaaaaacaatgggtggaagaagaaatcaaaatgaaaattagaaaataattagggatgaatgaaaatataaacatcacatacctaaacttatgagatgcagctaaagcagtggttagagggaaatgtatagatgtaaacacagatgtatatttaaaaggaaagaggatctcaaatcaataaattaaccttccacctaagagactgaaaaaagaagggcaaactaaactcaaagctagcagaagaaaggaaataatacagaccggagcagaaattaataaaatagtgaattcaaaaaaatagagaaaattaaaggaactaaaagcttgttcttggaaaagatgacaaatttgacaaacttttagctagataataaaaaagagagaattcatattgctggaatcagtaatgaaaagggaatattactactgccattgcagaaataaaaattatcataaggaaaggccatgaacaattttattccaataaattagataacttagataaaatggacaaattactagaaaggcataaactactgaaactgactcaagaagaaatagataatctgaatagacttcttctaagaaataaatagattgaattagtaatcaaaaaactacctaccaagaaaagcccaggcccaaatggcttcattggtgaatgctaccaaatatttagagaacaattaatactaattcttcacaaactcttacaaaataatggaaaaggagggctaacttcctaaatcatcctatgatgccagcattgcccagataccaaagccagataaagacatcacaagaaaggaaaactacagaccatatatcttaagaatatgggtacaaaaaccttcaagaaaataataggaacttgaatccagcaacatataaaaagaattgtacaccatgaccaagtgggatttatcctagcaaggccaagttggtttaacaccccaaaattaattaatgtaatacactacatcaatagaaaaaacatataatagtctcaattgatttagaaaaataatttgacaaaatccaaaaccatttcaagataaaaaatattcaacaagctagaaatagaaaggaacttcctcaacttgataaagggtatctatgaaaaacctacagccaacatcatacttaatagtgaaagactgaatgtttttcccctaagatgaggaacaaaacaggatgtctgctctaaccacttctactcaatattgtactatgggttctacccagggtagttaagcaaagatacaagtaaaagccatctagtttagaaaggaagaagtaaaattaactctattcatgaataacattatcttatatatagaatatcctaaagaatccactaaaagtctattagaactagtaaatgagttcagcaaggtttatgggatacaagatcaatatataaaaatcaattgtctgagttacgagcataaatgtaaacaaagaaaaaatgttaaaaacaaaaatatcaattgtctttctatacacttccaatgaacaacctgaaaaggaaattaagaaaaataattataatgcaacctaaaataataaaatatttaggaataaatatcacaaaagaagggcaaagactatactctgaaaactacaacatattgttgcaaaagtaaacatttaaataaatggaaaaacatatcattttcatggattagaagatttaatattgtcagattggcaatattccccaaatttacctacagatttaacataatccatccctatcagaatcccagtttatttcttttttagaaattcacaagtggaacgtaaaattcatatgaaatttcaagggactcagactaattaaaaaaatattaaaaaacaaaattgaataacttacatttccttatttaaaatgtattacaaagcaacagtaatcaagacattggaactggtataaacatagacaaatggattagtggaatcaaattgagagtccagaaataaacccatacatctatagtcaaatgatttttgaccattcaatggggaaggaagagcactatcaaacaaattgtgctggtataactgcatagccacatgcaaaagaaagaaattggacccttaccttagactatataaaaaaattaactcaaaatgaatcaaagaactaaatgaaaaagttaaaaccataaaacttttggaaaaaacataggaaaaaaatcttcatgacctctttttgggcaatcgattcttatatgtgaaaaaacacaggcatcaaatgaaaagaatagataaatcgcactttatttttatcaaaataaaaacttttgtgtttcaaaggacactattttttttttttaaagaaggaagggctttattcagccaggagcttcggcaagactcacgtctccaacaactgagctccccgagtgagaaattcctgtcccttttaagggctcatgactctaagggggtccacatgagagggtcgtgattgactgaccaagcacggggtatgtgacttggggctgcatgtaccggtaattagaacagaacagaacaggacagggattttcacagtgcttttctatgcaatgtctgtaatctttagataacataaccgattaggtcaggggtcgatctttaactaccaggcccagggtgtggcaccgggctgtctgcttgtggatttcatttctgccttttagtttttacttcttctttctttggaggcagaaattgggcataagacaatatgaggggtggtctcctcccttattcccccgctttgagaacctcattcaatagtggaagttctcacttttattctcactacccatgtcttcttgcaagacagatcaatagtgattcatatagtacacttgtgctgaagcattttggtgaactaaggtagtgatgaagctttttatcatttgaagaagtacaggtagcaaacaagggagcagtaagcaggtttctattactattataactcataagagttttaaatctttttttattattatactttaagttctagggtacatgtgcacaacatgcaggtttgttacatatgtatacatgcgccatgttggtgtgctgcacccattaactcatcatttacactctcattttttgcactcaggttcagcatacttactagctttcatttaaaacatgccaaatactttactagtctggggatttgtccatggaatgttatttatcttaccacttctctgactcattccttattcttgtgacagttctaaggttcagtgtcatttcaacattcctccataaccctatgtaaattacatccttaaaataacatttaaaataacattttaaatgtgaataagtgattatcaattgagaataattttgtcctctggctactttttgacatcacaactggaagatgctactatctagtggataggggccaaggtactgctgtccttttttaccaggaacagcctttatgccacaaaacaaagaattattcagtccaaaatgtcaatagtgctaaagtttataaactctgcttttgatcatgcacaataaatttgaaatacatatttgtttgggtgtttgttttaacatctgtctttcctactagactggatgtttcataaggatgagatagataatgcctagtttgcttaacattgaatatccagcatcaacctcagtgtctgatgccaggtagctacatgaaaggatgaaacagcaggcatgaggtaagaagaaaaggaaaggctttattaggagggtatacaaacatttctgggtatagaagatgctgtcagtgccctgtccatactccaacagctcataccatttaagtagatatttgcctgactttcaaatgtcagaacccttatttctttgtgtgagacctttcattaggtcatcagagcccactgtgctcaataatatgacagtccagaacagtgggacatcatctgcccctggaagatgtgtttactacagcgttctctaaagttttacagtgacattagctgcttgataacgaatactttgtttgcttcctttccttctctgtctcaattcctctcttccctgccagagtttcctgggaataactcctgtgataggccgagtaatggtccccaaagatacttagatcctaaccccttgcacttatgaatgttgccttatatggaaaaagagaattcacaaagatgattgtggaagatgggagattattctgtattatctgatagaacctaaggtcaatcacacaagttcataaaagagtgaggcagaggcgaatttgacacagaagaaggaaatgtgactactgaagaaaaatgctatgctgctggctgtaaataggaaggaaggggcccatgagataaggaatgcagctctaggagctgggaaagtcaaggaaacagaccctcctctagagtccccagagggagtatggcaatgttgacaccttattttcagcctagtgaaactgattttgaacttctgacctccaggtttgtaagatactaaatgcgtgtattttaaagctaccaaatttatggcaattcattagagcagccatagggatctatcacaatgtttggtccctggaagtgggttgctgctataagaaatatctaaaaatgtggaagtggctttgcaactggataatagctatagactggaataattttcaggagcattatataacaaccttagattatgttgaacagatcattaatagaaatatgaatgttcaaagtgttcctggtgagagctcagacatgaggaacacagtagagaaagtctatattgtcttagagaacacctaaattatcataaacaaactattgatagaaataaaatgtcaaaggtgttgctggtgaatgcttagaaagaaattagtaacataatatcagaaaagggagtttgtgttatatagcatcagaaatcctacctgaattgtgctctacaattatgtggaaagcaggacttgtaagcaatgaacttgaatatttagctgagcagattttcatgcaaaggattaaaggaatggcctgttttttattgctgtttatagtaaaatgccagaggaaagacataaattgagggaagaactgttaagcaaaaagaaaccagaattcaatgatatgagaaattttcagcctatccagattgcaaaagacaccaaaattaggaaattcattgccacaaaatcatcctccagagataaaatcaagggcgtggctagacatccttttgttagtgcctttaagggatcaaaagatcaaagtattcaatcacatagatggtgttttgaagagatatggggtgtgcttctcagaataagcaaggaatagagatgggattttctatgagggatcttgaagaagcctcttgtctaatggcatgaatccccatgacatacataaaaggcctgtaagtttttgacaatgttatatcagcagaaacaatgccagcttagactgaaagggacaaatagaggaagaaatgaaagaagtctacaggactctcaaaatttgacaggaggaagcaggctgataaaactactcagctgtaaacatatgctaccattcaaaataaaggaacaatgactgagggcagaacctagaggccagagggcagatttatgaccccaggtgaagtcataggatcagagtcatcaaagggaggagtctcaagccttagaatattctcaggccttgaaacctaatggttggattttgaaaatgcttggatttgagactcctttttctttccactttttcccttgtggaatggcaaagttattggctgtaaatgaaccaaagtcaaagggaaaacacagaattagtagagaagaaaattaaataatagaaaagaaacatctcttagtgctttggcttcacctaggagggacaagaaatacacatctgggcttaaactgagcacaagatgcacttctctatcaactgtttacctggcactgacaggtaaacttattgaacatcttattattattattatttttgagaccgagtcccgctctgtctcccaggctggagtgtggtggcacgatctcggctcactgcaaactccacttcccgggttcacaccattctctggcctcagcctcccaagtagctgggactacaggcgcccgccaccacgcccggctaattatttttatttttatttttatttttagtagagacggggtttaactgtggtctcgatctcctgaccttgtgatccacccacctctgcctcccacagtgctgggattacaggagtgagccactgcgcccggctgagcatcttattattaattgaaaaatgactaaaatatatttttcaaatggggtaaaatcatgacactcatacagatatgaaatgaacacatgctaaaagaaaaagatgttatgactgcttcaaaagggaaaccaaagagttgatatgggaatattcatcagtaatattaaatgattgtgtaaatggaggcaaaactggtttcataaggtgaagaacaaccgaacctctactaaagaatatgctgtacatgtatcagcagcctacaactaacaaaaggctataaaagacttcacagataatgtaaggctggaatcagataacctgcagtggtgtcctaaagacagagcaaagttttccactgaagcacacatttatttttataatgtcaaaatcaggtagagagttatagttccctcaaaatcaaggttcagtcattagcgtgactagatcagtgtcatagacatttctaggctgaggtctgataagggaccagtggacaccaatgaaatcacaaagtctagggatgtcacaaaggcagctagctccctgaccaataagggcctggagcagagggatacaataggcaggactaagcactagtgtcctcagagacctacttgagctagagaatcaagcagagctgatgagagccaaacccagcaaacatcatgtcagagaaaaagaactgtaagaactcgtctacaaataacaaccagactcaagacccttctagaaatgagctacaggtccctaggagcttcgtggaccgcgttgtgcaagatgaacgagacgtccaaagccagagttcctccacaataaataccctccttaccttgctcgattgccttgctgactacatcatggagcgggtaggcttggaggccagcaacaatggcagtatgcgcaacacttcacaagatagggagagagaagtggacaacaaccgtgagccccacagcgctgagagtgatgtgactcgctttttgtttgatgagatgcccaaatccaggaagaatgactgaagactgggtcccagagccttgaagggaacctcacaggcttagccagggcaaaaatgtgtcacagctgaggaatatctgctgttgtcatcaacaagtgctattaaaggatgtaaatccatgagtatgtttctgactcctctcagtttctgtcgctttgggttgtaggtgtctgtaagacatccaggggaagctatccccagagagctgaaggcggggaaggggtggccagtgtggtgtttgaatcagtgatttagagggggcagtttccaatggtgacagtgagggcgccggccctgtggggaggaactggctgggataaagacaccgagacttcctcattgtctctgaacaggaaggccttgtgaggccagggagttggctgggggcctctgaggcttgttgaattcccagcctgatgctggggcctgaggtggagctgcagactctgactgaggtgcaggaggctttattcaggatagcaaaggtctgaagtcagagggcggtggccacaggggtgggtggagaggggcacactggctggcatgaagttcatgggacaggggctttacatggagattgaagagtgaaggagaaaccatcatgaaaaatgcaaaaaagaaatgatggcctgctggatttcatttcttatttctttatgccctgccttattatgaaagcggatttgagacagggattattagctagtgctgtgaatatatctttttgtcctctcttcaggacactggtaaaataaatcaaaagaatatataaaatttatgatctggcctaagatgggcaattcaagaagttcttaatggttgttaattattaatgaatcagcttaattataaatgtatttcatttaaaacacgattaacaatttcatttttaaattgaatacttattcattataattaccatatattgcatagagcaccaaaggattattagtgactcaatccatgttttaagaggtatagaaataattctgtcccaagtggcggcctctaaagcacatgcaatccttttcaaaacttcctgctctgtgctaagtttaaaagaggtgtcacatcaagtgttgtagcaatctgtccccttgcctgtgagtgcccacattttaggtttccacctcttccttgggtccttgggagccacagtctgctgcctgctggcctttcacagagggttggtcagaggctgcacagccggctccaacaatgggagctgcgggcctgggtttcagatcccagttcaccacttcctggacatgtgatattagaccttcaattactccctctgagcagtcctcctcatgtgtaaaatgggggtagtaaaagtctctccatctgtgggttttcccaagattgagtccacttgtgcctgtaaactgctgttccacacagtgcatgcacagggtcccccttaataaacagttgcatctccttccttccctaacagcagacctgtaggcaggcttccccaaggtgcagtggtcctggttctcaggtgaccactggggacttaggccactggctgtgagaaccacatcctgctgagccctgtggagagacaggaggaatttgggaatatttaatttatgtaagcaaaagagactttataatcgaacacgtcaataccatccagaggtaggaaaactttacataatcacacaatcagaggtggagctatttcagaattacaagcacatagacatataggcacagagagatagagcttatagcttcagttctacaatttcaaccgtgagtcaagtgtaaatagaaacagtaaagttctctgatccaaatataaaaaaaaaaactgttctcctctaagagagtataaaattcttaattgatttgagctataaatagacaaatggacaaaagactgtcaaaccagattttctgttgtcttttacacaacagagactgtatttctatgaatcattaactcatttacacagctctccagatggttggatcctaaaactgaattcccaaccatttggtcaacaatgaaaataacttacctaatgtcaatgaacaacaacaacaacaacaaaatacagaattagtagagaaaaatattgaaataaaaattaaatgttgaaactaaaattagaaaaacacaatgaacaaagacttatttgggctttggagtcacctagatgaggcaagcaaagacattcctgggtttaaccaagcatgaagcacacatctctgtcaccaagtttgcctagctctgatagatgaatccactgggtataacattgtgacctttaaaaacaggtaaaaggtattttctaacagagtaaaatcataacactcaaacacctatgatatggaaatgcgttgaaacaatcgattaactcgtgaggaaattggcggatattataagccattcaaaagggaattcaaagaataaacataggaacattgatcatgaatgtttaagtaaatgtatacatggaggcaaaattgggagcaaggcagtgaacatgtctgtaagtgacttacagcttctagagggaatgtaaattagctcacagacaatgcaaggctaaacttaaagaacctggagtggtgtcctaaagacaggacaatactttcattgacacaattttttgctaaaatgttaaatagaaaatgagcttttccttaaaaataagttccagctactagggcaaccaggttcctctcaaaaagaagttccagttactggggtgaccaggttcctctcaaaaagaagttccagttactagggcaaccaggttcctctcaaaaagaagttccagttgctagggtgaccaggttcctctcaaaaagaagctccagttactagggtgaccaggttcctttcaaaaagaagctccggttactggggcaaccaggtccctctcaaaaggaagttccagttgctagggtgatcaggttcctctcatgggcttttctaggctgaggcctgatcagagcccagtggacaccaatgacatcaaaaagtggaggttgtcacaaaggcaactccctgaccaatgaggggctggagcatagggatacagtgggtggcaataagcactggtaccttgagaggctcaggccagcaggaaaatcaagctgtgccaattggggcaaaacccagcaattcctcatggctggaaacaaaatgttctgtaggcctaggagacaacgcctttcccattccagaagagcagagctgcagtttcctgtcagccacttggaacgctgcctgcgagaaagtcagcatgcccggcacctgagctcaaccacacctgttttcctggctggtgttctcgagtatctgacagccaacatcctggaaaaggtgggcaaggaggtcaagaacagctgcaggctgtgcatcaccccagaacacgtgaagagggcactgcaaaaggatgagcagctcagatggatcttggagttggaagatgacacccactctcaagtagaagaaatgccccaatctgaggaggaagaggaggaggaggaggagaaggaggaggagatggtggtgctggtggtgatggggggaaggaggaggaggaggagaagaaggaggaggaaggattcctgagtttcggagccatgcgggacttcatcagcaacctcctccagatgccaaaattcccatagatgaaagaccccaggttgcttccatctgcccaagctattaaactgtgtaaatgcatgacagtgctcctgactcgtctccgtttccgttgctttgggttggaggtgtctgtgagacatcaaggagaagctatccccagagagctgaagcgggggaaggggtggccagtgtggagtgtttgaatcagtgatttagagggggcagtttccaatggtgacagtgagggtgccggccctgtggggaggaactggctgggataaagacgccgagacttcctcattgtctctgaacaggaaggccttgtgaggccagggagttggctggggtcctccgaggcttgttgaattcccagcctgatgctggggcctagggtggagctgcagactctgactgaggtgcaggaggctttattcaggataacaaaggtctgaaatcagagggcggtggccacagaggtgggtggaaagagggcacacgggctggcatgaacttcatgggacaggggatttacatggagattgtgttgggattgtccttagggctatttgggagatatgcttgtctgaatcccagaagcctttcttgccacatgatttccactgaaccttatattcccaggcaactcattgtgaagatgcccaccccaccactggatgattccttatggagagctatagagcattcctagctttagcccagatggtcactttctcctctgtgcatttgagcagcaagcaggcctctctccagcatctacaggaaggaagtctccttcagctgatcaaatcatggtgacaacagcgccctctccacttgccaaagtgaaacatctttgttttcagggtatgtgttcctgctagtccagtgtcctccattcaagtgagtccctctaggatgggtaatggcagtgaactgatcattttcctcagatcttgacatgttgattaaatagctgtctggtgtttaaaagctgttgatgttgcttatggctgtggcttattgtagaactagatataatgtcctggatacactggaatgcacatctgaggacttcattcaaggcaggagaagccatagtaggtgggtggcccatggcagatgagtccctctgtgtagtcaggtggtcaccttacagtttatgcagtcgtcaacactaacggtcactctgaccttgtaaggacccgggcttctgggctctttcagactctgtttcatgcctgaggtggagtttggaggttgaccctggatgagcccctgttgcaagctctctgcagagtcaaggggcatgggagagtcagcaggaggcactgctatccctttaagaattgtgctcagctgtgctcgtgggtttcagaggaatcgtggggggccacagccagcatagcttcagactaatgcatcaccctgccagatcccccttccacacatgcaaggaattctacactcaggggaggtggggaggcagagagaatcactgttattgggaaggcatgagcccacccatatttaggccttttgtgcatttctaacaggagggagggaaaggtgaggaaggagtctctctggcctgtatcctgtggtcaggacagcactggtggccagtgtcctattgggagtgtgaaaactaacgcccaagtgggcaaggacagaggccggggtgactgtggctgccaaccaggccagggatcacaagcagtgtcagggcaggctggtgccagactcaggtcaagactgcagaaaacttcatgtgtgaagatagacaagccccagagtcaagcctgagggcaggagacttggagggtaaaggcaactttttgttggctttaccgcaaggcctggttatcaggctcgtctcccacctagagcatcttttgggaagcaaagcattttgaaggcccaggtctcctgttccctttatgtgatagatcctacatgatgtagcctatgggagatggcctgactccttagagagtacctccgttactcccaaaataggagtctagaaagagaggtacttctatcaacatctaacacatcattttcctaatcctcagattacaaagtggcagctcacatacctaatctggacagcagatgagatcattagaactacaatgctgtttttaaggaaaattattttgttgccaacattgaaaaatctagatctttcatctgaaaatctcaatttctgggtttccttagaaaatcaaaatgtctcggtatatatgtggctacagttagatagaaataattagctgctaccccattaagacgagatatttagtttcctacattcctcatgatggcagtggtggcccatctggggtggccgttgccatcatgccagctgcagcagggagccatgaccagggctgcacactttgtggagctggtgggagctggggacaagtgggagccctgtccctttcaaattggtgtggcagtagctccccggttgcagccgcagctgcccgagcggtggttgtggacccaggcctcccactccatggagcaggcaggagtcctgccctcctggacacagctgcagccatccaaatcgcggctgcagacccaggcatccctaccctcttggaaatgtctgctccccctgcttggctctccctgctgtcagtgcccactccaatctcaaagcaaagtcagggctgatcccaggtgctgtcacagccaggtcaggtgtgcacatgcttggggcagtgctgacacaccagttccctgctgccttagccccctccagactttgggctctgacaagcttaggaagggagacaatggggggccaaggacagctcagtgctggcctgcagatatcccctggcacctacagcctgggtgccatgaacggcagcaggaggcagacaggttcctaggtggaaggtccacattgaggccccgagttcaggccaggaagggcctgaaagctgggggctggactgcagtcctacagactggagcgggaatgtgttgtgctttatctgggcccacccatggccacccgtggaccagtcagcatacacttcctcccctctgaggcccttaaaagccagaggactcagccagagctgaacaaatgttgggaccaccagctgcagagaggagctagccaccccaagtcctcctctctgctgacagctgggaagatgacaggaagacctgcctacagagaggagcttcccactccaaggtctcctctctgctaggagctgaacactcatcaggacacccttgctgcagaaaggagctgccccctgtgggagactaagctattctattgctcagtaaagctccccttcatctttctcaccctccacttgttggtgtacctcattcttcctggtcacaagacaagaactcaggacccgtcaaatggtggggctaaaagagctttaacacaaacaggttgaaacatgccccttgctcgccatgttgcaggcaaagagaaagagagaagagttttggcccttcggggagcccagacctgagaactacttgagcaagggctgtcactccctctttggggctctgtggttcactggcatctccaaacttccaggtgccaccatgtttcccggtgccagctgtggaagctgcttgtcgtgcgcctggtccagtggcagcctcacagagagccggcacctattctggcatctggaactgcctgcctgccctgttgcagcagctggcatgtctgactgtgtgcagtggctgaaccccacgcttcctcacacaccccttgccgttccacaccttactcccccttgacaggtgtgggacccaggctggtaacatgagccaagcacagcctgccaggctgagtgggcacagcgagcccagcaggaccgagcacaactcagacaaaggtgccacctgccacagagatttctggccagaaaaacgacaccctaaagatctcataacacttactcttccctattgtatccgattactgactcatccctttccttaaagtacctgtctggcttctatagatgagttcattattctcactgtaatttaaatctccaactctaatgttcagaaggattccttctctaattactatagtgcagtgcagcactcctcagattatttatggtgtaaagccactattttctatttttcatgttctatttaatttagagatgatatgtggtcctattgtgcatgactactgtatggctcaccattgaatcatcactggagtttaacaacagtcagactggtatacaccctgtccaataagatgacttcactcacttaaatgtgtgacgaagacagatttctataaaggatcctgaatggtggtattcaattcctgtacctgttgcagccaatcagtaataaaaactttgtagccgtacactgttcctaaaatcacagtgtgtgtaacactggaatggtgaatttattgtattctattattttaggagtatgattttaaatgtaatgaagggcaataaatagaatctgcatttggcattttcttaatgtgtgtcttccaaaggactttatgagagtagaagatttgatcctcttaatgttctagaataactgtagggaaatatctctaacttattaaagcaaactctagtaaaggaaaccagttagcatcaaggaggcaggttacataccatggttgggagttatttgcattctgaaatgtaggatgaaaataattcatcagctcaactgtgaaggggagtcttcatgacaagaaaggggaaaatagtgaaaggaggggcagaagagctgacttctggtcccctcagtagaatttacttgggggaccatcagcttctgtggctgtaaaatgaggttggaaaaattatttcaaaggtcttcttgaggtatacagttatcagactatgctcttttcctaagaaagaatctctactgaaaatgggtaaaaggggaccagactttttttctaagttctccattttacagctgaggtcactgtggcccaaagatgataatcagctctttcaaggtcaaagcagggatgagagctggtcatcccacctgttgttgaagctctttcctctcctttatccttagaaatagcgctcaagatagaaggtgcttaatgttctcttctgggaaagtgaagctcatgtgttcaatgccaagatgttggggtcgcttggatttctaggaaagcactcacaacaacttgtgaggtctcattcttgatagtgagtcttgacaacactctcacttaacaactcactctcgagaactttcacttgtgttttatttggggaagcccagacaggttgggaaaaaagggctgattttataatgcaggtccttagacttcgaaaacctaggtcttgttccactggacgttgtgtaactgtgttgtgaacacaaatgcttctcagttaaggttttctggaaattctgactctatccactgacattgtcttaaatgtggttatggggtgatatgatgagcccaagcccaaaagtctattttttgaaaaattttatgggtacatagtaggtgtatgtatttatgggttacatagaaatgggaaaagttcccttgtccccctcacagggcatgtgatggacgtgtggctcacttcttcagtgccctgctgctcaaacccctagcgggagcatgcagactggtaggttgtggggctctgaccccatggcggtatctaaaggtgaatgtttacagatgaagcctcagtaggcatgtgttacagtatgctctttcagtttagccatctgtaggtagctcgtgttagtcagctcaattagacccactgccttatcgcaaggacagagggctttctgtatcccagggtttcttgccttggtgtactggaagaatcggatcacacatgggcttggagaacgagtgcgaggttttattgagtggaagtagctctcagcagatagcgaagccagaagggagatggagtgggaacgtggttttcccctggatccaggcccgctcagtggccgggctcttctccgaccgccccaaccgaactccgcattgttttgctggtcaatggcctgccaacctgccagcatctgccagtgcctgtcggtgcgctctgccagcgtgctcctcttgatgtccagctgcttgtttctctgcccgcgaagatcttggggtttttataagcacaggataggggtgtggtgggccagcgtggtcttgggaaatgcaacatttgggcaggaaaaaatgtctgtcctcacctaggtccctggtcacaggcccaggggtggagccctagccacagaccacaccctcccctacccagcacttccctgccctcctcccatatcaacatgagatattttgatgcaggtcttcaatacgtaatcatcacatcagggtaaatggggtatccatgacctcaagcatttatcctttgtgttataaacaatccagttatagtttctttgttaatttaaaatgtacaattaaattattttggactatagtcactgttgtgctagcaaatactagcatagaaaaactagaaagaattaatgtcttatttattctttctattttttgcacccattaaccctcccaacttcccctccagcaccctactacccttcctggcctctggtaaacatctttctaccctctgttctcacgagttcaaatatttcaatttttagttcccacaaatatgtgagaacatgtgaaatttgtctttctgtgcctggcctatttcacttaacataatgacctccagtttcttccatgttgttgcaaatgataggatctcattcttctttatggcttggtagtgctccattgtgtatatgtaccacattttctctatccatctgttgatggacatataggttgttttcaaatcttgtctattataaatggtgctgcaataaatatgggagtgcagatatctcttggatatactgatttcctttcttttagttatataccgagcagtgggattgttggatcatatagtagctctattttgagtttttttaaatatatatattttttactatactttaagttttagggtacatgtgcacaatgtgcaggtttgttacatatgtatacatgtgccatgctggtgtgctgcacccattaactcttcatttaacattaggtatatctcctaatgctatccctccccactccccccaccccacaacagtccccagagtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatcaactcattggtttttatggctgcatagtattccatggtgtatatgtgccacattttcttaatccagtctaacattgttggacagttgggttggttccaagtctttgctattgtgaatagtgctgcaataaacatacgtgtgcatgtgtctttatagcagcatgatttataatcctttgggtatatatccagtaatgggatggctgggtcaaatggtatttctactctagatccctgaggaatcgccacactgacttccacaatggttgaactagttaacagtcccaccaacagtgtaaaagtgttcctatttctccacatcctctccagcacctgttgtttcctgacttttggatgatcgccattctaactggtgtgagatggtatctcattgtggttttgatttgcatttctgtgatggccagtgatgatgagcattttttcatctgtcttttggctgcataaatgtcttcttttgagacgtgtctgttcatatcctttgcccactttttgatggggttgtttgtcttttttcttgtaaatttgtttgagttcattgtagattctggatattagccctttgtcagatgagtagattgcaaaaattttctcccattctgtaggttgcctgttcactctgatggtagttttcttttgctgtgcagaaactctttagtttaatgagatcccatttgtcaattttgtcttttgttgccattgcttttggtgttttagacatgaagtccttgcccatgcctatgtcctgaatggtattgcctagtttttcttctagggtttttatggttttaggtctaacatttaagtctttaatccatcttgaattaatttttgtataaggtgcaaggaagggatccagtttcagctttctacatatggctagccagttttcccagcaccatttatcaaatagggaatcctttccccattgcttgtttttctcaggtttgtcaaagatcagatagttgtagatatgcggtattatttctgagggctctgttctgttccattggtctatatgtctgttttggtaccagtaccatgctgttttggttactgtagccttgtagtatagtttgaagtcaggtagcgtgatacctccagtgttgttcttttggcttaggattgacttggcaatctccttaagctgataggcaacttcagcaaagtctcaggatacaaaatcaatgtacaaaaatcacaagcatttttatacaccaataacagacaaacagagagccaaatcctgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatatatatcgtgaaaatgtccatattgcccaaggtaatttatagattcaatgccatccccatcaagctaccaatgactttcttcacagaattggaaaaaactactttaagttcatattttgagtttttaaaggaaccttcaaactgttctctagagtggttgtactaatttgtattcacaccaacagtgtacaagtgttcccttttctccaaatcctcaccagcatttgttattgcttctcttttgggtataagccattttaactggagtaagatgacatctcattgtagttttgatttgcatttctctgatgatcactgatatttagcaccttttcatatgcctttttgccatttgtatgtcttcttttgagaaatgtctattgagatcccctgccagtttttaaatcagatcattatatttttccctatagagttattcgagctccttatatattctggttattaatcccttgtcagattggtagtttgcaaatattttctcctgctctgtaggttggctcttcactttgttgattgtttccttgccatgcaggagcttcttaacttgatgtgatcccatttgtcactgtttgttttggttgcctgtgcttgtggggtattactcaataaatccttgcccagtcaaatgtgctagagaggtttcccaatgttttgtttttgttgtttcatagtttgaggtcttagatttaaatagtacaatcgcatggagaaccgtttgtaggttcctcaaaaaattcaaaatagagctaccatatgatccagcaatcccactcctgagtatatacccaaaagaaaggaaatcagtatattcaagagatatctgcactcccatgtttactgcagcactatttacaatagacaaaatttggaagcaatataaatgtccatcaacagatgaatggataaagaaactgtggtacatatacacaatagagtgctaccatctataaagaagaatgagattctgtcgtttgcaacaacatggatggaactgaaggtcattatgttaagtcaaataagccagacacagaaaaaaaattttgcatattctcacttacttgtgggagctgaaaatgaaaataattgaactcatggagatagagagtagaaatatggttaccagaggctgggaagggtagtgaggtgctggggggaagtagggaggattaatgggtacaaaaatagaaagaatgaataagacatagtatttcttagtacaacagggtgactatagtaaaaataataatttaattgtgcattttaaaataatgaagacagtatgattgtattgtttgtaacacaaaggataattgcttgaggctatggataccccatttaccctgatgtgatctttatatattgcaagcctgtatcaaaatatctctgtaactcataaatatatacacctactatttttccataaaaattacaaataaaaaatcctaaaactcagcccttacaagatctgcaggggagacagaatttgtaggttgatctcccaaattcatcaggcttggaaaggaccttagactttctgcataactacattagcaaaaccaaaccaattctatggaaatgccaatattaatagaacaaatattaatactcctcagagggagatagcagagtctttacactatatgatccccattgtccaatatgcaataaaaaaattcaacatgcaaagaaacaagaaaatatcacctattgtcataaaatcagtagaaacagacccaaaaatgtccagttgttaaacttcatagaaaaagactaaatcaattattatgtattcaaagaacaaacagaaaataggttcaaagaatgaaaggaaaatatgatctttataaatgtacagatagtgaatttcagcagagaaatggaaactataaaaataaccacatggaaattttagagcttaaaaaattatagtaactgaaattaataacacactagatgggctcacattagtttggagatggctagcatcaaatgagcttgaagacagatcaaaagtaatcatccaatctgaaaaaaatggaacaaaacatgtatctctaaactttttaaaggtgttgtattgacttcttttgtatgagttttttaacataagaaagtaataactctcttggtacttcaagctagactcacgttttcgattctccaggacaccacctttggggttccccactgtagctaaaagggacctggctatggtaacataaatgggtaatcaccttggcagaagtgatcttaacaaaaatttcacttacttcaactaaagattcagtaccatacaagcactgagaaaacctcactcattctctaatgttcagctgagcaatcacatactgttacacatttgtcttctaaaagtcatacatacatagcacagtgctatgattagatacctggactatggttatggagtgcctggatttaacttttgactccagtacttactaactgggtgactgtgggcagactacttagtttgttcatttgtaatatggggataataatattatacacctaacacatttggagaattattggagaggatatatgtaaagcacttacaacagtgcctggcacatatgtgttcattgttatcacgtttctcccaggttttttaagaatagagattttcaggggtagaagaatattaaaagagtgaatcacctttaaaacactggtgtaaaaaatacctcatgtcaaaaaatgtttaaaatgtgctttagatgaaacctgttacctttcccctgctgatcaacagagacattcctttttgaaagctcagctttagagatactgccttcttcttgaaatagctgtctgcaacagataaacattactctgtgctactgggtgtgttcaatgtgtaaatagattgtgggaatatgagaggctggtttttcaagttcctgctccaagtagttcacaagggtcaagtagtccagcattctacagtttgtgtgtttgagagaaaaataagcccataaaaacattctaaccttcagattaaggtaagactaatgcgtttagggatctccagtgtgatatctgatttcttaatttctgtattttgtgtgtggtaggggagtagtgggatttgctggtcaggaagaaaacagctccttccaccatttgatattgtattttacagtaaaaaagggagaaatatgtacagaagggacattttggccattggtagctatgagtttaatggattgaggagagaaatataagtatctttttgttattaacacttgattctatctatgaagtgaagcattgcactaggttctactgaagagtgagtgcctccaggaacaaatatgcattctagtgacataaaaaaatcaaattcacagcagaagtgttgcatcattttgctataaatctctcacacctctctatataaacctctcacatctctatataacatagattgtccttttgctctgaatttctttcatttattagaaaatttagatgtttcatttggaattatttaattgtttttacattcagttccatttttgatatggacaaatatccagtatggatataaattcagtagaaggattaataaagtctgaaaaacctggaataatttcaacatgaatatgatactgtaacagcttacagaaatgcgatattaactgtgaacattaatatactctgaaaagatgcatcagggtttaaaaaatttctccttaatgtagattgttttaattaccaatactgtcttcctcatttaaatgaaaaacgtaattttacaactattaatatataacttctctttgctccaagtatatgtgtatgcctggagaaaagcatatgcctggagaaaacaggagttatatatttatagcattcaaaatagtataaaatattgtttacatgtaataatgcatttagaagtactacttcagtagtagcctccttaaaaagtattttaaacacaggaattaagtatataattttttcattttgtaataagttgtttatatgttatttggacaacagcttacacacaaaagtgttacaattcataccctaggtcttaaatgcatgaagccatttgtttggactctagtgaaatccttaaattggtccttgcatccctcagtatatatatgtacatacccacatatacatgcatatttacatgtgggcaactaataactgagaaaatgtcttactgctcttttagttgttgaatcatgctttttctatgtatttatgatttcctgaaattctttgctattttaagtttgggtattagctatgttatccttctatttattcagatttgttaaagtcttctgataggtttagtgaataaaattattgagcttctacctcttttcttttggaggcccatttagtatttttgttgaaattacttccttattattatttagtatgttaagggaaggaaaaggaaatgtagctttaatatgtaaaatgagcagttcgttttacttaagctctattatatgatgatgtatcttatgactattttgccatcctgcgtaagcacttagctaatcatctttaatacattctacttaaaatctacttgtaaatatgcttttgtacattcatatcttacttgtctgtggtctctcatcctctttctctctcacccctctatatacattcacacattttccatgatttcacaaaacttctctccaacctcgttccattcctggttatctctttctgtggggagtatcatcatttcctttgacctctgtttctctacatcttccatcttgcttagcccatggacttttgattttactgaagacagcaaaaaagcagatggtgcttctgttacttgcagagttagcaaccgctgtggttaccttaggttctgaaagattatctaaaatagggaggagctcctagaggaacaaaatataataaacatgtagtgtactgggataaaaaattcacttgatctggtctctctctccttttaacaaaaacatttctctaagaagtgattaataaaacataccctactgcctcactttctcttttaaaatctttctttcaaattcccctatgacataaaatcaatcttcatcactttattgacactgtacttccaagggtcacctgtagtgctgctaggaaattcaagtacattcatttatttatgtattcattcatccattcaataaatatttatttagtgacagctatgcatcaggcattgctgagcactgaagttacagtagggaacacttaagtctgcctttatatatctccagtctagttaggaagggtgttaactcacccaaataattcattacaagtgtgataagggctataaggaatacttttccaaattctcattttattcatccccttggctctatgtgacacacatgatcaattcctacttcttaaattttctctttccttcttgtccatgactctatactatttattcaactgcttttctaccacttcccttcttgtctatttttccttttctcttccttaagtttgggtttccctcaaaggtttagcatttatttagcctataacctattacgttttgcctttctctataacttcttatcaacccttagttttaaatatcacctctaagtggatacctccaagacttccatttccacatcttatcttttccatctgctatacattttcccacttgtatgtccaagggtcactcgacattcatcatgattgtagccaaactcacagcttttatgtcaaaccacttcccctttcatttcatttgtttctgtgaatggcattaatgatctcttggtttctcacatttgaaatcttggagtcaattttgcttctaacttttcctttgctctcaatatccaaaccactaccaagtccattcatttctttaattataatgtatctagaagccatcctctctcatctcccttttctgttatttttttcttttattctctattttctcatccttttttccctcagtctaagagctacctacaattcaaggttttggtcaggccccatctccatcagaaagtccacacctcatggatatcttctttttctaagccccagaatcattggggtagtgaaaagaacatagccaaagagccaggtttaagttttgattctaccattcactgccccctgtgcactctctgtgaaccacagtttcctcagactcattctatctcatatagtggccacaggaacaaatatagtcatggagaggaaatcattttgaactatgaagaactatatagatattaaagtaagatttgttgctggaagaataactcagtagcagagaccaaaaccccaggtcttaactattgaaatcatattgtgcaggggttgagagtgttgactctgcagtcagatgacctgagtttgaatctcagctctgctacttaccagctgcatgaaattgagaaaacttagttagctttcctgttgctgagtttcctcactgtcaattggggataacaatagtttctactgataagagtgttgtaggattagaacgtttagtaaatgtaaaatacttaaaatagtgcctagctcatagtaagtgctctgcaaatgtggaagaggtggtaggggcctatgaggctaagtgtggttacgaggtgaaagccaggtattagaactgagccaccagatggggattaggtacagcaaggatgcaagcacagagctacagactggacacatgtacctagatgaatccctcatgattcagataaaaaaaagaatgatcttgccatttggggcagaactgagcaaatgatggaggtatgaacgttctgagcgaccattcggggcacaaaaatggggataacagtctttcagacacattttctttttgttaaagaagaacaaatgttagattgcccttttgtgttgtgaaatatgtcagtatatcatggaatcaaaatgtcagtatccaaataaatgtccaaatgttgagaaagctgactcaactgtcctctatattctagaaatccgtctctttaacagtcatatgcttattgcatttcagaggacaagggcccttagaaatgtcattcctcacaatttataggattattgcccaaagtgtgtatttttactaatacacttggagattagtttgtttgattgtttcatgtcagaaagaaaaataataataatacttagaatattctaagggttgttctaagtgccttaaattttttaactcatttaatcttcacaagaacctcatgagatgaacatcatcatcatcaacatcatcgccactaccatttacataagaataaactgaggatcatagaggttaattggtaattggaccagatttcaaatccaagcagcccagcaccagaggcaattttctcaagcactgagtgctatcatatcagcaactctgtgttttagaatctggttaaaagggcatgctctggagtcctagactgctgttacatgttgcatctccagttttccttgacaagtggtaataaatgtttgatatttttcataattgataaaaattacttacataagatttatactaagtaatccaatgtccagtaatgctgtgcaagaagagtctggtttttctcatccattattctgtatttgagcatcaaacaaaggcctcaaatactgatgctctctgtttcctagagagtatgttatactgctggccgggcgcggtggctcacgcctgtaatcccagcactttgggaggccgaggcgggtggatcacgaggtcaggagatcgagaccatcctggctaacatggtgaaaccccgtctctactaaaaaaaatacaaaaaattagccgggcgcggtggctgccgcctatagtctcagctactcgggagactgaggcaggagaatggcgtgaacccaggaggcggagtttgcagtgagccaagatcgcgccactgcactccagcctgggcaaaagagcgagactccgtctcaaaaaaaaaaaaaagagagtatattatattgttttgccctgtacttaactgatgttgtacccgtgtacttaactgctgctgctgcccgtggggatattttctagggtatctgtgagtttccatctttgtctttgctaactatttcaaaagttcaggctcaatttttggagttgctatgtttgttttctatttcctattttaactacttcttgttcatttaaatgttctctcaccgtagtttagtgggattttttttttttacttttctctaagcgttagctacaaaaataacttaataggcttttagttcattttcttcttcactgaataagaatattaaaatcaaatttaccttcaccgaacacttaataacttttttcatttccaagaaggcccagtgccatttgtaactcttgttaaagtttaatttagcagtttccaatttttgtaacagtcgacttatccaggctaatttgatttaatatttctaacagaatgccaggaaacactctgttcctacaataagaacatgtctgattcatttaaatgaataagaacacgtctggttcatgtaaatagacttcagcggcatttttgttttggtgttgtgcagtcaaaaaatatttccgagagaatatcaggacttggaaagaaaccaagaaaatgaatacaaaacaactctaagatacatatcattctaaagcaagtaaaatcctcaagaccaaataatataatttaaacaaccatttaacattgataatgtttactaagaatggaagtggtagactttaccagaaaatatagttgagttggggtgggacgtgggggtgtgcaatagagaaaccaaacttggaaagaagccatcagataatgatgttccaggttcaaatataaactttaaatccaaatatacttttatctggattataaaaacgaaagttcagcaacagcccactttgtaaacacagaacaagagtgatcatatcaaacaggtttacttaatacaaatagcagagtatagacaaatccattaatatatccccctaagagctatttatgtacaacaatagtcttctctccctggtgtgaagttacattaaaatcagtatatgattaaaatttttgaaattgatttcattaaatcaagtgacattatatcaaagatcagttttcaaacaaagcagtaagagcctattgcaaaataggcatttttcccaactttcaacagataatggtatatccaaagatgtctgtggccacaaacaaatgtataatttttaagttgcatattttgactagaactagatatgtactaaaaaaccattttgtgatgaagaatcacttcccactaattgagagaccagcacagggagaatactattgatcttaaatacaaggaagtccagacattaatatggaaaaaatatagattgggatgtcctgtttgcattagccatgttcaagaaggaagaatttaatttgctttgaactactcacagctgccatctaattatttttgttgactgttacagagtttgagctccaaacacaggaaggttatttctaaatcagttatacacaacaaccaaacagctattgattttctttcaagtgaattcccatctgactcttattgttcttgtgaataatagtcatatgtatggctttatacttaagcacaataggatataactaaatattggctcaactcagacctaaagagtaggttcctgaacagtgagaatatcatctagtgataatctttcactgcttatactgggaaaaatgttgaacctgggtcagcaaacatgaaatgtaggttcagtactgctcctaatgataatgccaaaggctcacactttctgaggatttaccgtgactcaagaactattcaagtgttttctatgtaaccaaggcatacagaggttcagtcatgtttctcagaaattttagagccaagatttaaaccagagttcctgctttgtaccagagtcactttggtcagcttaagtaacttccaaaggcatcttcctggggtattttttcctgctgcaccaatttttacctttcttcctgattctcaggctcactcaatctatactggtatctgcgaacctgtcactgacctcaccccatctccagcatctcactgattggtttcctctccatgatcttttcttaaggggaccctgcattctttgggcccctcatcattactcaaggcccctagatctactggccccctcagtcctcctagtccctcaaccaccaccaactcctcctctcctagcttagctcccccattcctgctcacaggagccaggtagcatcaggacctccccaatctcattttcctctctaccctctccacactctgactactgtttcagcttttatttctttctttagtcagggcaatctgctctgatgtcatatcctacatcctctctacactgtcataataaaactcttttggtatgtacaagtgtgtaccctccaaagcaggagtgctgggcactggtataaatttgaccaatacaaaattaaacacacacacacacctgtgtgttatgttgtatattatgttatatataatattgttgtgtgtgtacatatatgttatatgtatgtatatttaattctacagtatattatagtggtcaagagcacagtcaatagagtcagaccccttagtcagaatccagcttcaccacttacaagctgtgtaacactggacaagttacttaacctccctctgccttggttttcctacctgtaatatgggaatagtgaaagtatctaaatcaaataattgatattgtaaaccaaaaggtatctgagacaggtctcaatcaatttacaaagtttattttgccaagattatggatgtgccagtgatacagcctcaggaggtcctgacgacatgtgcccaaggtgattgggacacagcttggttttatacattttagggagccgtgagacatcaatcagtataggtaagatgaacattggttcagtcaagaaaggcgggacaactctaagcagggagggggcttccaggtcacaggtagataggagacaaatggttgcattcttttgatattttgataagcacaatttacaggaatagtcacttatgccttagtctggcttagtgaaaaaacagggcaaaggaagcaatcagatacacatttgtcttctgtgacagagggatgactttgagttctccctgtcctttgtccacaagaaatttccctgtgagaaaaattgtgagggaggtatgtagcttttttatctttgtaggtatcttatttaggaatagaatgggaggcaggtttgcccaatgcagttcccagcttgacttttcccttcggcttagtgattttggggtccagagatttattttcctttcacaatgtaaagattgtactgttcatatatgtaaatcaagaattcataacagggcctgaaacttgtatataagtgctgagtgttcactatcattattaccatgactcataaggaaaaagcattaaggcaagtataataatggagcaggaaatatacatttaagtggaaaatatagtacaacatggataatatgacatgtgtgattaattacgacttgaataatgcgaagcatgtaattatttttggctttgcatttgatatctgaggaatcccaccatttcacatgaaaaagtgcatgtgacaaggaatcttccaggaattttgcattagaagttccttttgatcctcctcaaaaccctgtgaagttagtactattattatctccaccctgtatgaaaagaaaccaaggttcagagaggttaagtaacttagtttctgtaacatagtaattgccaaagctaggatttgaatgcagagcttcctgactccaaaacctgactctttgcaattctccacttgaggtgtccattggaaccccataggacgttaaaaaaaatccatggaacacaaactcaagagattctgtttttttgaaaagcagcttttgtgagatataatgtacatactgtacaattcacccatttgaagtgtacaattcaatgtttttttttttttagtctattcacagtgcgtttagccatcaccacaatctaatttcagaacactttcgctctgggcgggcatgtccacagaatccctggggtcttaatttcaaagccacagaccttgtaggagtcttgaatgaacttcaaatgatttgtgaactttttctaggatccacagctttcactatcttctctaaagtgataaaaatataagccaaaaatgtattaagaaactctagaccagaatggccttgaactttaaggtacaaatcactgggggaccttgttaaaatttagattcaaattcagtagctctggaatgcgctaggcctactatcattaattttaatgataggaatgctcactttaagttagatgttatgtgccctaaaattccattcttctctttagtagatctatgctatgaaataactgcactcaattattattgttatatttttaatgtcatcggtaaaatattggcagacatttattttcttgattgatgcatacttatccacaaaatagctatggttttggctcttggcgcaaaaagtctaaaatatttactaattgttccttaatagaaaaagtttgccaacctctaatatagaccatgggggaaagccacctttaaggagcagaaatgttgttcatcttactctccacagctccttgctacatgtggcagacatgacattatcaatcagacttataggaatcctaaccaagtatgaggggcagcaagctggctatatttatgtataactcctcctctagaggagaaatctgggcagatgagggtcaacttcacttttagtttaaaaatacatctccctagagcttcaagctgctctcctgggtgatagcatgggtgggtgtccacaaaagaccttcatgcattttcagttaggtcatgtctctatgatcttggaagcaagattccctaagagtagtctgcaatccatatagagagcttggttaattgggtttggatgatggttcaccaaacgtacaggtagaatattttatcttcttacactcaccttcaagctacttacattaaggtgtttgttcagaacattgaactttcaagagctgtctgaccatgcatttcatatgtatgaaggcatttctgcttattttccaacactaactcactttgaatgctgcaaaaatgatctatgctatgttaatgcctgaatatgcatgacttcaaaattctccaggcttcaggtggtctcctgcaccataagcctctactgcagagcatcctcttagacatccatcttgaactattttttccttatgtcttagtctatgactttagatctcctaactaatggttgatttttcagccaattttgttgttgttgttgttgttgttttttgatgcgagaggttgcccattctcaaaacccacttccttcttccaaccaatgcccattgctacaaggcccgcaactgtgttcagctttcagcatgctccaggggaacaagtacaaagtctgacctggatggaattagattatgcaccaaaataattccaggatttactaatttatatcattagaaacctagaatgttaggccaaggaagatgtaatataacactggattaggccaaatgtattgatatggtgcatttttcagagattctggatttagtgtgatacttcttgcagctggaggtgttgttaacagtttacttgattgtttagttgaaatgtgaacttagcaatgacctacatcattgactctgtgtgatatacttgactcccagttcattagacttaactaactgctcctcccattctgttgatcatccctcttcagtctctttcatcatctcatttattcctcttgtccctggaccaaaccgaagatcaggctgcttattctcatggcccgataacgagattcagataagctgggaaagaaggaagtttatttctgtaaccggctatggctgaaaaatatctccagaccaactcaaaattacaaagttttttgactttgtaattttgagttggtctggagatatttttgacaaagagcttatataccttctaagctatatgtctacatgtaagtgtgcattcatctaaagacataagtgatttacttcttctattctataactaagatctgactcctaaagaccttcctctggagcctcagtaaatttacttaatctaaatgggtccaggtgccggcggtgattacccttatcttgtctcctgctaaatcatggaggtctggggagttccttcagacccccaataaacttgtttgtggaggtctggggcgtttcttcagacccccagtaaagtttgttttatcctaaatgggtcctgttaagaattccttcattatcttgccatacttcaaggcccaggaaaggcctgggcaaaactcttggtgggcttttgttaccttccagcctttgtataagggcactggctctatcagcttttaatatttaacttcaccactcagtcagtgctgaaacagttgttatggaggcctgcgttagtgagacctggcctgccacactctgtccattctttaaatattgttgcttctcatgattctatcttttgcccctttcacttctcttcctggtaatctcacttgcttgcacagcatcaaccaccatccaccatcgaggcaccaatgattcccaattaaatacctctagtatagacatctgataagctataaacagtttatgggaagtttcctattctaaatgcctttctggacaggtctttgttgttgcatcataagtacctttgttgttgcaccataagtatccggacctcaacatatctaaattgcaattaattatttttttttctctttcaacgttttttgtcttgtactctccatcactgtgaacagtattatcatcaacatttctaggctttacccccgtgttactgaatcaggctctctggagatagacacccagaaatctatttttaacaatatacttaggtattcttatgcacactaaaatttaaaaacctttgcagttccccatgctggaaacctcagagtcattctcttttctcttccataccacccacatcgaagaggtcactggatcttattgagattattctaaaacgtcccaaaagtgactcttattttccttcccactacacagctttagttcctaatctctccctggcacttctgcaagagcctcctcattttgtctacctgacctttcccctgtctttcatccaatcactgagtgctggtctttcaaaaaacaaataaaaaattcaaatatgattgcgctgttccttggctttaaagcttcaacagcttgatggcatgagaacagttttcaggcttcttaaggtcatggaattctttcttcaaataaaatcctaccaggaaatctaacttatagaacagatgaaaacggagctgctctgtttgaagcagtcgtcggcgccacaggcttggccactcagcctctttcgctgtgtttcctaagaaaacattcctgaagatacagtttgaaaaacactggataaagtccatattctttgtttggatgccaaattcctcccactctgacatccccctttctcttagctttccaatattaacccagaccccagacctggagttagtcactatttcttctggactagttgtgtgttcttatgactttttcacatttgctgtctctacaacctagaatgaccacttttttcttcctaattgttttttcctttgtgttctcaaagccaaaattgggatttatgaaactgtgattttatgtttatgcttgtctccactagaaaataatagaaaatagagaagccccttgaaaacagaacctatgcattcttcatgaatgtatcccctagatccagcacagtttctttttttgttttttatttgtttgtttgtttgtttgagacaaagtctcactctgtcgcccaggctggagtgcagtggcgtgttcttggctcactgcaccctccacctcccacgtggagggtgcctcagcccgggtgcctcagcctcccaagtagctgggactacaggtgtgtgccaccatgcccaactaactttttatttatagcagagatgagagctcattatattgcccaggctggtttcgaactcctgagctcaggtgatccgcccgcttcggcctcccaaagagctgggattacagacctgagccacaatgcctggcccaacatagtttctgacacatgattctatacgtgtttactgcacgaacatttatatgctctataactcattctatctgttctttggttttatattttcttcagaccgaacatgtctttttgaattaaacatcactttaggaactagatgtattaacttcaaagctatatgacactcatactgttctttgcctgtgttgtagcctagcatgataattattgataatcagtggatatatgcattgtgcatcatgacatatgaagcagaggtaatatggctataagatatttttgacagaaatgccatttgctgtatttttttaactgattttatatgtaacatgtattcattgtaaaaacatataaagaaaattataaagaagatattaaaatacatttataactatccagaaatagacttaatattttggcttattttttctcattctttcttctataatacatatatgtgtgtgcatatatatatatatatatatatatatatatatatatatatatttcttttaatataattgggaccatactgcataagtaattttgtatcctgagtttttttcactgcctttgtattgtgagccttcaagcatgccatcacatataaaaagactattagtattattaataatggtattaattaaaaattatgatgtttctaaggaattgctaagatttataaattcttaatagaaagtctaggaagccagagacctctgggtattttgtgaatcaaagggaatggaggtttgtgttggactgatgcattttaatgacgtattgcttaacttcattgagaatagaaacgatggaggggtctaaattttctgagcatctgttatatgccaggcattgtgctagacactttttatacattaactcattttaatattcaaatgatatattcttcaaacccaggaagtagatattaatatgcccatttaacagatgaataaactgagatgcaaagacaaagtagcacatctatgttattatctcagggagtagaattttaattccattagtttccaaagcccataccctttcctctaccccacactttctccaacaccaactttgagagggtacacaaagtcagtcttttattctgaagatgttgtattagcagtgcttaccctgtggaccataagcccttgggtgaccacagtttataaacccctgaaattacctccctttgtcattagaatgtatatgtatatttttgaggtagagagcctatagttgtcactgattatctaagggatcaactgttcccaacaatgtttatgaatctctactgcaaataatgggatgtatacaagtattgcagaagccctttgaggagtctttagttttgcttgtcaggccctgtggtgaggggctatattccaattttcattttaggcatcacttctcaaatgtcttattttgcatttaattcataaatttattcatttggcaatattttcaaatacctactatggtgccaggagttgtgaggtgttaggaatacagggctgatcaagacaaaacgagatatcccacagagcttagacattagcagggaaaaccaatgcatgttggttaaaatcagcattttaaatcagcatgatgagtgcttggcatagtccttagcattgttcaccaaatatttacgatttcttcctcttgtaggcagatggcaggataccatttactggcccccttgtaattgggtagggctaagtgaccatcagttctgtttaaggagttgtaagtagaaataatgtttttcacttccaggccaggacatttaattcctactatgaaacctttcagaactcttttttccctctggtgtggcaattggcagtgttcaagatggtagctccctaaacagcctggattcttgagggatatatagcatggccaagaaatatgaaataaacctgtgctgttacaagctgttgcaatttgcgagttatttgtgtcacaacatagtctaccccagtactgctcaaaatgtctgtgatgaaggatcaggttgtttgttacttttattttcaacctggatagaatagtatttttgcaaaatacaatttaagtaaattagcagataaatgagacatgaaatacataaacattcaagtacaaattttcatcagattcaacagatttaaaattactctgtcaaattactataaaaatttctaaatgcttattcttaatttctttacttatataattgcaaaccagtaagtttacagacctgcactggtttgcaacccaaactttgaataaagctgtattagcctatcccaactgatacagtgttactgtaagagaagtatgaaaatgtattggatagatactatgagtttccaattgctgctgtagccaatcaccacaaacatattgtcttaaaacaatacaatgtattatcttacagttctgaaggttaaaagtccaaaatgagtcttgggagactaaaatcatggtgttagcagggttgcatttcttctggagcctgcaggagaatctgtttccttgtcttttccagcttctagaggccatctgcattccttggcttgtggctgttcctccaacttcaaagcccatcacctcagcctctgcttatgtcgtcacacctgcttttctgactttaactctactacctccctcttgtaaggatcattgtgattacattgggatcacccatctaatccaggctaatctctttatctcaagacctttcacgtaatcacatctgcaaagttttgccatctaaggtaacatattcacaggttctggggataaggatgtggacttctctgggagccattattcagtttatcatagatagctaagctaaactaggagtcagccatttaagtagatccctgtggatacttaggaattaggagatggagaaatgggggaagtatcccaggcagagtcttacaaataggaagatctggaggtgaggaagattatggcttttttagaggaatgaacttttgagtgtggttagaggatagatacgagagagagagatcagcaagggacaaatcatgaagggttttgtaaaccatattaaacaacttgaactcttaaagagcaaagggaagacatcaaagggtattcagtataaaagcaacaattatcaatttgtattttggaattgcatatagaagagccagattggaggcacaaaactatgatgctgatgaaccacggtggtgtcacctaattcacagcatgtctgaaacccaaatccattatttcccacaaaagccagcacattctccatcttccctattgttttcttctaggattcaattcttaacattatttttagcctctttctttctttggcttcttactctagtcagtcaccacaccttattggttcttgaaaattttttaaagacataatatatggttacatgaatacatccaaaataataaacaatatggaaataagtcccttttcatcccttctctgacccctaacaatccaactctcatcttcatatgcaacctgattcattatcaatatgtattatcctgtgccttttattatgcatttacatttattatgtacatgcatatatctactgcattgttttaaaagcatttgcattaaaaagcataattatcttgtctattttcagctcgcaatataacttagatattttccatgtcaatatatttattttaaatgcctcattttaaaattgaacatcggtattgctctcttttccagcttcgagagcttctaactctaatagattctaacagtttctaactttagactattacaaactttatcttataacttatttttcaaatctttctcttttgaaatttttattaaggctttctcttagccagcatttttaaaggtagaagtagtcttctctttaaaaatatcaaaatacacaatgccaagaaaataaacagtgatcttaaatattaggttggtgtaaaagtaattgcagtttttaccattaaaagtaatagcaaaaactgcaattacttttgcaccaacctaatacctttttccaaactgagagctctgtgaaaattcacagtggacattaaagactctgagaagttctgtagaaaaaaaaatatttaacttggtttaactctacatatccaaattttttgttgaactacatcacttgatatggtttggctgtgtccccaccctaatctcttgaattgtagctcccacaatccccacgtgttgtgggagggacctggtgggaggtaattgaatcatggaatcatggggacgggttttcccatactgttctggtgatagtgaataagtctcacgagatatgatggtttaataaagggcagttaccctgcactcgctcttttgcctgccaccatgtaagacgtgcctttgttcctcctttgccttccaccatgattgtgaggacccccaccccagccatatggaaatgtgagtccattaaagctctttttttttaaataaattacccagtttcaggtatttcttcatagcagtatgaaaatggactaatacagcactgttaacaattccatataatatctaataacatctcatgggatactgttgttccatgaagtcactgtgtggcctcaaatgtagtggttacaagcagggtccctgaaaccaaactattctgaattacttaccagttgaccttgggcaagttacttaacatctctgtgcctcagttttctcatctataaaataggaataatagcaatttgtttcattaggaagtcataaggattagttgaataagtgttagtggttattatttggagcattctgaggatactgctcttgaagtattggtatgaagttgatggcactgttagcctctctactgttatttgaagaatccatatcattgtgaaattaaaaaaaaaatcttgactatggcactcccatataatgtaccacacagaattgcccgtgtgagaagaaacagctctgttgcaaagaaattcctgtaattccatagcatctctctttgagtcattcagtttggggttcgttgtaaaagtactacttttttctctatccacagcatgacagttcttaccttttgacagtcttgtggactgctgtgcttgtggtaatccaatcacagctgctttgcaggatgactgctcctctatttgaaaggcatcctcaagggtattttgcgtatgtgatttagcttgtattctaagcatcctaaacatctctgtaagtgtgctgaaaattcatctaatttgtattgtcacatggtgacagtcaaacaggaaattaactttatttctattaatttcatcctaagagcactctcagaaacattctatatttaaagctgcatttcaagtacacagtaatgagatatattcagatataccctttcctttgattcaaatatcggcccctattatttttaggtgtgtgttactcaaaatagatgctttttaaacttatgtccctttgtgatgctatgagagtatttgactaccacatctttttgataatcagaagttaatgacttgtccaaagttatctatgctgaaaggcaatagaatgacatacaaagcatcttgccatctttctaaacagcttagcatagttcaacaaagttactggccacagagggaaaaatctacatctatatttaaagagagagatctgtttaagttaggaattgaacaataaaagaaaaatgaatttcaccctcctaatctgactagtgtttactagccccatttaactaaaagaatgaggatcaattactcatttttttctctacttgattaaaatgtgtaatgggtaagggattctccaggtgaggtatgaaatcgctgaaaagagacacacagtgatgatatatcctcaggtgaagtcattgcagtccagatgctggtcttcagtgcaaaggctgaaaaatttgatttggttagcacacagcaaacagatctgacatgggttcaaactaaaccaaatatggagaactccatagacaggaccagaacattcactcctgaagggagagctctatgggaagccaacttataatcaaaagtgtctggaaggaagtgagattgagcaagggtaattagctgtatgatttgagtgattcgtggcatgaaaatttctcagaatgaggctccatcacctagcatggaacatgcgctacagggaacaaacaactattttcattttcattccctttctctagttggagtctggatgggcactgacatcacctagctccttagatcttccttgtctatgccttggttcactgtctccttttcttcaccctgtatttctccggaaggactgcgttatcatcaactgcattctatcttactaaatttatagtcatagttcagtgctgccttctggagaaaacatcctgattttcttgatagagttttgcctacttctgatctccttagccaactgttactggaaaggggtcccgatccagatcccaagagtgggttcctggatctcacacaagaaggaattgggggtgagtccatagagtaaagtgaaaacaagtttattaagaaagtaaaggaataaaagaatggctactccataggccgagcagccccaagggctgttggttgtccatttttatgcttatttcttgattatatgctaaacaaggggtggattattcatgcctcccctttttagatcatacagggtaactttctaatgttgccatggcatctgtaaactgtcatggcactggtgggagtgtagcaatgaggatgaccagaggtcactcttgtcaccatcttggttttgcagcttcttcactgcagttttatcaacaaggtctttatgacctgtaccttgtgctgacctcctgtctcatcctgtgacttagaatacttaaccctctgggaatgcagcccagtaggtttcagcctcattttacccagctcctatttaagatggcattgctctggttcaaacacctctgacattttccccttcccttttacaagagaatccttaatcctaagggttgcagaggaatgaagatccatcttttgtaacttcttcatgctgaacaggggtgatgatattcctgcctaactattagggtctcttgtattcagagtagagaggagctcagttggaaagtgtcattacagtgagggccattcataactcttgagttctgacaaaaggtgatatctggaagattagtaagtgttcaatttaagaaaattttcagtaaacttattttgcattattacacaaagagtacaactgcaatatattccacaacagtaaagcaaaataagcaaaattatcccaagtaaactaaattagaaggctttccatgaactgggcaactgttggaaacaagctgatatggagtcactagccaattccaatatgtgcccagaattataatattgaaccatatttttacattacacagcccttttgtttcttttgagatgcagtcagacatcacgaattggttaacaggaataagcagggtcagtctaaattgcaggaaaaaaacgacaacaacaacaaaaaacaactgataagactagaatttaataacagaagtaccatacttctagaaacacaatttttctctgtctagttttccatttgtattaaagacaaatcatggtaagaccaatttgattgcaaaataatccttagtcttatatttaggctgattatttgtataaagtgcagcaagaataattatttttcacataggctttttaaattggctttgatggaattctgtcccataagaaatctcaaataagaccttttttttaaagccaagcccagccatgggtttatatcctcaaatacctatgaattaattcttcttcttttttttttttttttgagatggagtttcactcttgttgcccaagctggagtgcaatggcaaaatctcggctcactgcaacctctgcctcccaggttcaagtgattctcctgcctcagcttcctgagtagctggaattataggtgcctgcccccatgccttgctaattttttgtatttttagtagagatgggggtttcactatgttcgccaggctggtttcaaactcctgaccttgtgatctgcccacctcagcctcccaaagtgttgggattacaggcatgagccactgcgcccagccaattcttctcctcttgaggtcccaagataaccttcagctcctggacctattagaaagtgatattctttacttaccacaagtcagaaaccctgtacagggaatgtgtagacaagatataaggtcagttttcccaaggggcttttattggctctacaaatcaagtttgattccttaaaggaaaatgcatcattccagtcaaagccttggtaaaataatcagtttctccaattgtgtcctgttgcaaaagaaaacagattcttattgtgcttatgcaaataactatattgccataagttaagaatactcacaaataggttccaattctggagaagtcaggtagagagaaacaaatatgcctcaaattttgttcacaagagtacactttactcaactgttaaaagctataaatagctcaaaagaagagttttcttgtctctgaaaaacaaaacaaaggatcagcaacgttttaagcaaaaagtcaaaaagatcactttggtcttctattagctcaatccatgcagttaactcctgtcctgcttgatatttattaacatttcagcttttcatgagagtcctgaaagtttttttctttattctaatgtcataatccccaatgttatcagaaacctgcattcaagaacacctgttaaagtcctttagctgactataaaccaccttttaaataggattaaaataagacaacaactgttggtggatgacaaaatgtcttagggcagtcacagtcaaaagatatgattgacaaagcaatttgattacctcggtggcaatgttgacaatgtttcctgtatgatttttataccaaataagccaaacgtcatttttatattagtgtactactaatgttaaaccctatccttaataaaactttatagatacatctaaccaattttaatatttgaccataaggtaagattcttataccttttataactctttacaaatttatgttaaaaagtagattagtgctctaagaaaaacctgttgtgcttatattccaatgttcaattcatggaagaactgaataatacccctttaactttagccaatatgttcacacacagaatttcttttaaaagattagtttgtcacaagactttcccaactcactcaaaccttcaagcatatcctatctaacttcaaacaatcctttaaacttttaggcaaaaaaaagtccacattcctatgacttcttataatattttaccaaaaacgcatttcagtttctttacacaccttgcatgtaaaactgtttcttcagttgtctcaataacatattacaatgttagcttttagcaatttttacttttggtgaaaaacctggttagtaagcgattttaattatgtaccaggtgtggcacctaagacaacagataagatttgactttttccagcatagctagggggcatggctaacatcacatgtccccaggtcttatctagaatctaatgctctaaagtaggtaaattgaacaattttcaaaagtcaaacaagcagtttatgaccttaaagcatttagaaagcttaatatctgacctgtaaaatttagaccaaatgtctttattttatcaataatctttaaaactgtttttactttccaaagattacttaagtcgtgtactaaaaggcattacactttttacttttctgacaaaatatttgatttaagctcttatttttaaactaattaaagtttttaaaaatatctcacacacacacacaacacatataaatacacatacagaagaagattcagtagttgtaagacttttcatttgccagtttctaagtttgtctttaaggcatgcagtttctagggcttaacttgcaggcacagctggaaggcaaaacagatatacaaaattaaggatcccatttttatgccagatcctggatcccaaaaagagggaatcagcccatctccataggagtcttatctctcagcggtgggtggggacttttttttaaccttctaggttgccaacagcatacttctctgatctaaacatgcaaaaagccacatattcccccaataactgccattagccttccccaaaagtatatttcctacctagttattacacaacaaagttctctcataatactaagcaatttctgaccccccaaaagtgaaaaacgttggataatgcaatgcaaaacagaatagaaccttagatttttaaaggaatctatccatttccaattcctggagtttcatgaggaaaacaagtttttcccagaacccagtctgtggtgcctcctctgtttttcccaaggagtctcatgctgttagagcttgaatatccgctttaaataagctaaattttaaccatagcgctctttttaaaaagtccttttaaatctcttattaccgaaccaggccaaatggccaatattcctgtcttctgaactttaccaaaggtaatctcccaggtgctcaaagaaaggaaaaattccagaagggaagccggaagttgttcatcatgggtggggaagagaatctacaaatggcaaaagtcacacagatatcaaactagaaaagactcattccctaatcctggaattgaagctgggccaccgttgtaaaatggtgaagcctttgatgctgagctacagcattgggcagtttccattgcccttcccagaaggagcttagagcagccaattttgaacttgcaaaggcttttaacttctcaaggtaatttttagggctaaccatgaattccaaagttcctgctctccggaaggtggagaccaagagaaagtactgccacatagttataaggtcaagctctcaaggaaataaaataagatgagagggaaactttatccagttttttgtttttgttttttttagggacctgcagcaaagtttgtaactgaccagtttgctgggctggcttgaacagcgggcttacaggagtcctaagcctgtgttctatcttaaggtacccttctccattatagaacaacacagaaagacaaatttataacacaaagtacagattttactacagcttaagactagcctcacaattcctttttctgattaatcaaaacttgatagagttttggctacttctgatctccttagccacccatttacacaccagttacgataatattagtctgttggtccaggtacagatgaataaaaattcatttaggactaattttcttaattaaactctcacagggcaattttatttctcttatattctcacttgatctctcgtcttctctgtcaccttcatgtgctacccatggtgttacttccctcccttcatcctcctcacagggcagactcttggatttttagagagaagatttgtatttatagcccaaggcagggatagctataagcttcaggtcaagcatttttatagctaccaaccccttgaataatttctgaatatgattctataaaacattcacaaagtaaagtctaagtctgacatttcaaacacaaaatatgtcttcaatgaaccctgggtgtaatgataacatagtcattcactgagttttcaattttttttccatttcatcacaataccagatgagatacacaaggggttgaaaaaaacaactgtgttctttctctgcggagactgcagttgacagtgatgcaaaaaacaattaacctttctgaaaagccctgtttatcctaaccttattgtttcctgttcttttcaaacttggagcactctgggccttgttgcctctagagctttcaagatggagggaagacctggagtaaatccagagaatatgcactaacctgaacagcttcctaagagggggctggctctttgtctgtaggaagcagttcatttctgagtcatttcagcaaagttctggtttggtgtacactgtatagaacaaacacataggggtttgtggaagtcgaggaagctctggacaagatcctctcctttcagatctcctgagattttggggtcagcctgacctcatggttactgggaggccccaaagcagcctttaagtatgtatgtagttattcctgggagccttcctagaggcaagcataccaagtgtaacttgcaggtaaattgtagttcatagatcttggggaaagctaagggacagtatcatgggatgatgcccaatcacaaaaatcaggtagattacccaagaagtcatcattcttaagcagctttagagagagaatccaggtaacaaaccaatgaaagaatgtgctcaagagttaggatgagagtcagggcctggtgagcttcttatgttgacaaaggggtagttttaaaacatccattttacaatatacaatacatacctaaaataattcacaaacaaccatgtacatcatgagatataaacactcattttgagagcaaaacattacccaatgcattgaagccgctgtgttctcttctgtaattgaatacctgtgtccaccagaggtaatcatgatcttgaatttcctaatttgcctatatttatactatgaatgtaggcatttctaaattatatatatatttgcaagttatatacttcacatatatatgtatatatgtatatgctatcatttttcatgaattcttccgtaacgtaattttttttttaagagacagggtctcactcttttgcccaggctatagggcagtggtgaaatctcaaagctcactacagtcctaggctcaagtgattacctcctgccttagccttccaagtacctgggactacaggtatctgccaccatgcccagctaatttttaaattttttgtagagacatgggtctcactatgttgcccaggctagtctgaaactcctggcctcaagagatcctcccaccctggcctcccaaaatgttgggattacagatgtgagccaccacacccagcctgtaacttaattttttttattcagcagtgtttgtgagatctatttaggttgatgcatgtagcagaggttcgtatttgtctcaacagcagggctttttatgctgtgggcctagttttggaaaggaaggaagaaagaaggagggagccacttaaaggccctgatctgttatgggcagtccagattgtgcacttagtgtcccaaagtggtgacccaattcacccatcagtcagctgcaagagtggcgacgtgatgcagctggcggaggaagctaattataatggagaaaactgaatttgcatagagaaccaggaatcaactaaatccaaataacatttcctggttaaaaaaacactaaataaagatttaataaatgcatgtttactgttttaaaaaatagttttttgagttagatacaacaaaatttcaaaaattaggcagttttacaagtgctatgggaaaaatagcctaattaaatttttctctcctcttttttttctccaccgtcttagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggtagtattctttttattttttcagtcctccttgactgctttctgtttgtttgaagcaatttagatcagaaatgggccaagtgcaaccacaatggggacagatgtcagttaggaacttcatgagttctcatcagtagcccaaatatcggaaaactttggcatttcaccatttagccagacatgaaaatggaatttagctaataaagtggtattgatgagaacacttaatttgctaataaagtcataatttttagttaagaggaaggactacctaagtttgagtaccagctctggcaagtattagtcgtgtgactttgagcaagctactcaacttccctatgccttggtttcctcatcggtaaaacaaagataataacagtatccaccttatagggttgttgtaaagattaaggaagtttatacatatgtagtgcctgtcacctaagtgttcaataaatgttagctattatttatttgtaatgccattgtcagatcagtcttactggggatttgcctccagcacagctgcgagaagaaagggacctggagagtaaaaatttcccatcataccccagaaaccacttgaatttttaaaaataagtttcttgtgaagaaagttgaacgatgtgggcacagttgaatttcatatccactgtaggcagagctcatatttagctggtttccccggcatgacttcacctaatatttcagccagcatcaattctgattggttgcgtcgcctgctctaattggtcacatcattgttctgatcatttgcaaaatccactgtgattggctgctgcctgtaccgtctttgttttaaaatatatttggtcattacaccttaccccagaaaaaaaggagcagaaatagtgttccttcctcagtcactgccaactatgcaatgtgtaggttttgtgtcttgtatggctccccaagctacaatcagaagcttatgtttattttacctgaggagaaaacttatcatgtgattatattcacatgttgaaaaaatctttaatgtgcccaaagccactaggatctttagaaatggaaataatttaagtattcttgattgatgtttatttcacagttaagagcccagaagcttcatttccacttttccaagatattcaactaatcttgaagaaacaaaagtttcgatgaaaattattgcactttttctatgcatagaattcaggtggcaacaaaatgtagttaataatttcaaagaaatcatgaataatatttttgacattagtagtcaagtcatgaaaagtaaactaatttgtgtaatgccctgccaaaaaaaattatgttgtttatagggggtgacatattaactaggaattgatgacattccaaggggaatttaaaatcatttctgtcctggctaacacggtgaaaccccatctctactaaaaatacaaaaaattagccgggcgtggtggcgggtgcctgtagtcccagctactcaggaggctgaggcgggagaatggcatgaacccgggaggcggagcttgcagtgagccgagattgcgccactgcactccagcctgggcggcagagccagactccgtctcaaaaaaaaaaaaaaaatcatttctggccgggcgtggtggctcacgcctgtaatcccagcactttgggaggcagaggtgggcggatcaggaggtggggagattgagaccatcctagccaacatgatgaaaccccgtctctactaaaaatacaaaaattagcagggcgtggtggtgcacgcctgtagtcccagctactcgggaggctgaggcaggagaatcacttgaaccccagaggtggaggttgcagtaagccaagatcacgccactgcactcaagcctggtgacagagtgagactctgtctcaaaaaaaattatttctataggaataaacaatttaataaccagatgcccagagacaatgaagtacaatgaataggactttgttctgaatatttgtttctgtcattatcaataacttgtattaataattgttggctgggcgcagtggctcacgtctgtaatcccagcactttgggaggctgaggagggtggaccacctgaggtcaggagtttgagaccagcctggccaacatggcgaaaccccgtctctactaaaaatacaaaaattagcgggtcacagtggtgtgcgcctgtaatcccagctactcgggaggctgaggcaggagaatcgcttgaacccaggaggcggagcttgcagtgagccaagatcgtgccattgcactccagcctgggtgacagagccagactccatctcaaaaaataataataataacaattattattattatactctttcttcctttttctcattccatttttcttccctagtcttctttccttattccctataagtaaattcggttaaattgggtgtaatatacaacagagtatcaagaataaagtcattggtttcctggctcttcaaacttttttgagaatagcataagaaaggctgtttataaatccaagagatacttttacagaaaagagattttctaaagctacgtcttgtctccttgttccatctgcattaactgcattagatgtgttgtctcattttgttctgagttcttgtaatatgactcaggcttcaccactcttaacagcttggtgtattcagaagtcattccaaagtgggtggcatgatgttgagggtgtatgctgttgaatcacacagccagagttcaaatcttactttcggcatgaaatatctgtatcattttagacaagatgtttccatggataaatctagtttccccatttgacaacagaaataatatcagtgacatcataagattgttctaaggattaaataagctaatattacaaacagcttagagcaatgccagcatacagtaagcactcaaaaattgttggttataatcattagccctatagttggtttgtggtgcccttgatttgctagttgcagtagacactatcagtgctctactcagatcccctggagtccctctcacctcctagttttcatgcactttattctaaggacttgaagtacaaaattaccttcgggtgactggagtttcccataggattaaagagacacaagtgccaggtaaacttgagtgttaactgggtagcccaaagccaatggttgacgggtacagaaatccattgcctcaaggcagaacagactctgcaatgcaacttaagctccagagcttcccgtgggatgatgctgaggctggacttcacctaaaaatcacacccttgcttagcccctctccctgccttctcctgcctcccttactcccttatagatttctcttgagagcactacataagtcgcttgcacacaaatctacatagcagaattcgcttctagaaaacccagtctgagacactatgaagtttgtattaccaaagctattactatttagtaaagttcgtttcaggggaaatataataagtctgcaaggtgagcattaaaataaagaattttggttcatttgatttacaagctatgatcttcccaacaatttttatcacagtcattgtggtttacatactggtaaagaaaaaagtccaagctaaagaaagaagcccaagattaagcatcttggtcagataatataactttctgttggcttttctccctttatctcctctgaatagccattttattatgaatttaagtacaacctaaatcagttcagggtaccttaactttagcgcagtgggtctgcatggcaattaaattctgcaaacatttttctgatagatagatagatagatagatagatagatagatagatagatagataaaaatatttattataaagaattggctcatatgattatggaggctgagaagttcagacctaggagagatgatggtataatttgaatctgagtccaaaggctgagaaccgggagagctgatgcaataagttccaatccatgtctggcagtcagtagcaagggaaaactgatgtcccagcctgaagacagggagagaaaattcattcttactcagctttttactctattcagaccttcagcgggttagacgaggtacatccatattggggagggcaacctactttactcagtctactaattcaaatattaatctcatacagaaacaccctcacagaaacatccagaaataatgtttaacaaaatatctgggctcccagtggtccagttaagttgatacaaataattaactgtctcaggaatttatataaagctggctatagcccccgttcccacacttttgtgaattgtatagctcatcctgactctgtacccccgcttctgttgaactctcctctctccttgcatctcaccacttatggctattccttactcttttctttgccaggccagagaacttagtcctttttccttgatatcctccaaaaccatcaatacaagaaatttagatgggtaacagattttattacaacagtaaactttggtgctagctattacaatagttttcatcatgctatagaggtacaaatggatattttggggggagtctaaaggaagaagtaattaattacaagtaagatagaaactgaagcaatggtttcacagaaaaggtgaacgtttgtgcttgcctttgaaatgtgaaaaggacttttcacattggcaaatataggtcaactatgttttggctgtttaccatgagccacaaagccaccttcagactgtactaatcagtttcagaaggaaatggaaaccaaaattttttttagactgaaaaagattacaaagaataaacttatctgaaaagttagtaaagtggagtttgggaggcagtggatttattgttcgtttgtgtgtttatttgtttgaatagcttgtcctttgagataaaaatgtagaagacggagaaagcgtaaaaattgtactgaatcaatattttaggcctgacacccaaatgtgcttcacagtccacatacccactaaagtgtggcattgattaaggtgggactggtctttggggactcgtaaaggtgctccatacccagaaggcacatggcaagcctgataattacctccaggcataaatcatcagctggggaataggcatctgtctactaccattgcattttaagttcattcaagaggctgaaatatatttgtatacattcttctccttcagactaagcaggaaggagtggtaggagatagcgagacacaggttttcactgttagagggtaagaatatttttaaggttctctatggagagcaagtcactcaaatttattgacggctttactgcaatgaagaaaaagcagaaatgttgcaaataaaattgagctatcaacaattattgcaaatggataaaaatactgacagtttcgaagcacaaaatggaaatcattgttgattattttgattttgtaccttagattgcttttcatttacttcaaaagaactcagactaacatgtacgtgggtcataatatctactccaaaaaaatctcattaacaaatttttactctacttgatctctcacacctaaaaacaaatactgttaaatatctactttgtggtattgacttgtacttaaaaatcctcaacttattagtgaatattcatttcagcagtatattgtgagctttattctcactaagggtacatcatttccatttgaccaccatacatgaaaacatatctgcacatgttttctttggcacctaatcttgggcttgcctcagtggtaaactctattggttgccttacaacataacatttctcctttctttctatccaaatcaaagttttattcagctctagcagtgaattttttaaacaaattttttctcaaaaaaaattttttttattttttaaaaaatgttttaggccaggcgtggtggctcacgcctgtaatcccagcactttgggagaccaaggcgggcagatcatgaggtcaggagatcgagaccatcctggctaacacggtaaaaccccatccctactaaaaatacaaaaaattacccgggcgtggtggcatgcgcctgtagtcccagctactgggaggctgaggcaggagaatcgcttgaacctgggaggtggaggttgcagtgagccgaggtcgcaccactgcactccaacctgggcgacagagcgagactccatctcaaaaaaaaaaaaaagttttaaatatttgtgggtacatagtaggtgtatatatttatgggatacatgagatgttttgatacaggcatgccatgtgaaacaaacacatcatggagaatggggtatccatctcctcaagtgtttatcccttgagttacaaataatccaaataaattctttactttaaaatatattattaagttattattgactatagtcaccacactgtgctatcaaatagtaggtcttattcatactttctatttttttaactcattaaccatcccccccccgacccgagccccacactaccctttccagcctctggcaaccatccttctactatctatgtccaggagttcaattgatttgatttttaaatcccacaaataagtgagaacatgcgaagtttgtctttctgtaccaggcttatttcacttaacatagtgatctccagaccatccatgttgttgcaaatgactggattacactcttttttatggctgaatagtacaccattgtgtatatgtaccacgttttgtttatccattcatctgttgatggctgcttccaaatcttggctattgtgaacagtgctgcaacaagcataggagtgcagatatctcttcaatatactggcttcctttttttgggtatatacctaggagtgggattgctggatcatatggtagatcaatttgtagtttcttgaggaactgccaaactgttctctatagtggttgtactaatttacattttcaccaacagtgtatgaaagttccttttcctctgcatcctcgccagcaaatgtattttggtttcttgtgtaaagctggctcagttgaaatgcgccactaaataagccagaacttaatatctccaagagaccacagaccccagcctagtaactcccattcaccttatggttttctcttaatgtgactgattttgtcatttcagtgctaggagaagagaaggaaggagaaacaggaggggagcgtgcattcaaattgcttatttggaatcctgcagataagttcaatatttggttcaaatggatttgaagtgatttcaagaattatacattcagcctggaagtcagggagtctaagcgccaagcaataatacccttttaatacactataaatgtttgatcatttgtttgtttttccaaatcttatcactctaccactaagagcaaaattagtttgaccttctcaaaagcctaaagactcattgtccccataaaacaccaggagaactgttggactggacttctagtttggtaaacactttggtttaatcctaatagaattgccacaaagcttcttaacggattaacagaaactcccagcatgaacatactggctccctaatggaactcaaatgcttaatgagtcacagaaaaatgaacaaaaatattcagatctgccttaaaccttggacgttttcctagcaaagaccttaccaatttcaatatataattacatttagggaaactaactttaattttgattctagagcatttttctccgaggaagcgttacttgtaaggtgcaccataggcacagggccacaaatacctgatattcagagacatgttaaacattggattgtccaaataaataaacttgccagatcatttttaatatttttttacattttattttattgacacatagtagatgtacatattttcagggtacatgttataatttcatacatttatataatttgtaaagatcaaatcagtgtagttgtgatatccatcaccttaagtatttatcttttccttatgctagaaacattctaattattctcttctagctatttcagaccattttcttgggggtttgaaataatagatcaccatagtcataagtaagattgttacctgagactatatctattatctgtatctacatatgtctctatatagagatctatattatttcaaattattaacgtgtttatattatattcatataagatatatattatttcaaatacctagactatatatagaaatatatatagagataggttttctctctacatatataagtggagagagtctatataaagagagactcagtataggctggggattggtttcagggcccgggtgtataccaaaagccacacatactcaaggctaaagttggccttgtggaacttgtgtatagggagagttggcccactgtaaatgtgggtttcatattccacaaatactgtgttttcaatcttcatttggttgcaaatgcagaactcaaggttatggagatccaactttgtttattttttaaaaatccacatatagatgaacctgggcagttcaaacccatgttgttcaaggatcctctgtatattttttactcttccccatattcccattttactaccctttcccttccttgtgtattgtctctagccagaattggtatagaggtcatgtctctaggcagcaggggttagttggcactcacatcccaagaaactaccattccctttcaatgcaaattgcagaaacagaacaataaagcccatgtaatccagaacctggctgaatgttggggctggaagggggagtaaagaagacccatcccctcaaaggtaagtcagctcataagggaatatctaatatcaactatatccttggagaaataggtattttattcctaagaaaatgatataagtgaaaacttcactaataaaaatgtcaccactaatattttagatttcaggcaagtgaccattttatatcaacagtaatcttataagaatgttcctatgttaatagaagttatggtttaaccaatttaaatttataataagattaggctaacatgcatttcataatttttataattgttcttttattgcagagtaattaagcataatgaaaatatttaatgcaaagaaattaataaaattcttacacagcaagcaattttttaaagtttttaatctcagtattgtgctaggatctataaagggcatcaatgtctgcaacttttaaaataccataaacctcaatccacttaaacatttaatatcttctgatacatattttcattatagaatcaatgggcttattacagaaaattacataaccatataatatgaacattaaagtctcacatagaattccactttccagaggtgaatagtctccatttgtgttgaatttccttcctgtcacttttatgtgtatatatatacacatatatatatgcaattttcatatagttggaaattgcatgaaatttacatatacatactgtataaaatatcataaacctcaatctgcttaaacatttaatattgtctggtacatattttcattaatagaatcaatgggcttattatagaaaattagataaccatataatatgaacattaaagtctcacatagaattccacttcccagaggtaaatagtctccatttgtgttgaatttccctcctgtaacttttatgtatgtatgtatgtatatatatatatatatatatatatatatacatatatatatacatattttcatatagctggaaattgcatgaaatttacatatacatactatatatgtaaattttattctttatttttgctttgcattatttcatgaacatttttcatgtcattaaaaattatttgtaaacatttttattggctggataagatttcataacataagatttttccatataacatgaatgtgcaacgtgtttcttaactatttattcttatttccatgaacattctcattcttaaatcctcttatattgtgattcatattttgaataatatttccttaattttaaaaaccggcaatctgagaaaattgattcaattaagaccatgcatcttgtgaatcagattgtttattgtttatcacaaatctcaccttcctttcgtagaatctgaaagtttgtaattaactgccagtgatggttttcagtgaagcatttaaggaaagaacaacacataaaggaaacatttatattcatattcaacaaatttcaaagaaatggtgacaacatttcttgtatcatgtactgatactgacaactagggaaactgctcgaaatgtgttttgcaataacctttatctgtgaaaatgtgaatccccataagtatcacctaaaaaggtaaaatgggaaaaagtaagtactgataactgcctttgctgaacatataaccccttccccaccacatttaaaataatttagtttgcacaaattcaatttagagtcattctagaaataaacttcagttatacatttataaaaactaaaatggaaaccctctagtatgtgtccatattcagcagcagaattggttttaaagaatttttcatgagcaacatgttctctctaaagtatcagtttttttgtatgaatgcccaattttcttccatcaagtcaattctatcattgcattgtgataccaaatattttaagaagcccagcattttatcttggttgttttttaaagaaatgcagctttcctacttcttgctgtactgattctatctccatctctgtttttttctgagtaatttatcatattgataacaagactttctgatgtttttaatactcgagcaaggtattctttgggtttcagattagcaaaacacattcttgtttcttaatgggccaggaaattgagacaatagttattttaagatagttccatgtgggagacttggtttgctaattacgtatgagataaatttctgctatgataagactatagtgaataaacagcaaggtatcaaattgcagtgattcctaactcctttagagttgtaacgagctgtttttgtcatattatttataagatccctgtcttaggttggattcccccagaggtagaccttgaactcatgatttgtgtgcaagtgatttattaaagagaaaccataaactactagtagggaaagcaacacaggaaaggagaagaatctaagcaagggtgagaagtcaggcaaaatttggcagaggtcaccatcatcatgactttacagagacagataatgtttgctgttttgtctccattgtcctttttaaaaagaattcagaatgaatgcttgagtcattgtccctttgcatatatgagcacatttaatgtttctggaaaatctgtaataagtcattgattctcttaggttataagggattggttaagttcttcctcgtatttctgtggttttaattattttccctaaaactgttacttttcagcattattgctccgttgttttcagtattttttggatttgggttttttgttttgttttgttttgttttttgtcaattgcctgtcagttgacatggttttgtgagattttccggtatattcctatgagccaagctttttaatatcaggaagtttcttctgcagatatgaagacttcacaatgccctctttccttgagactatttgtaaacatgaaattggcacaagtcacaagacttctttatctaaacaagtgttcttttactccttcttcttgttactttctcttaagcagctttttatccaggcataactttttcccagttctcagagagttgtgattctttttaatagcctttgatttgaaaactaatcaaaagttatacaaaatgtattaagatagagtcatgcttgttgaagaatgactctcttggggaatatttgtcatgagagactttgtgataagatccagtttgggcagatgccatatgttgaaagaagctgggcgggcggaagaaaccctccatgtttactgaggcttaactttgagtgtgctcagcatggctttgcacagctaggaaagaaacaacagtcatgaataaatacggagtcctttctgagcaaaaatattttaatatattgagagccagtgggaggatactggtgtgtgggaagagtgcagattttggaatgtaaaattcagggtctgaatcctgacctccttatttaatagccctgtgacccacaagttacctctcggagattccactttcctgtctataaaatgggaatcataatgtatttttcatgggttgttgtcaaagcaatggtatgacatgtgtattagttcgttttcatgctgctgataaagacatacccaagactgggcaatttacaaaagaaaaaggtttaatggactcacagttccacatggctggggaggcctcacaatcaaggcagaaggtgagaggcacgtctcacatggtggcagacaggagaagagaacttgtgcagggaaaattccctttataaaagcatcagatctcatgagacttattcactatcatgagaatagcatgggaaagacccacccaaatgattcaattatttcccaccaggtccctcccacaacacatgggaattatgggaactacaattcaagatgaaacttgggtggggacagagccaaaccatatcattctgcctcttgcccttcccaaatctcatgtcctcacatttcaaaaccaatcatgccttcccaacagtctcccaaagtcttaactcatttcagcattaactcaaaagtctgcagtccaaagtctcatctgagacaaggcaagtccctcccatctatgagcctgtaaaatcaaaagcaagttagttacttcctagatacaatggggtacaggcattaggtaaatacagccattccaaatgggagagattggccaaaatgaaggggttataagccccatgcaagtctgaaatccaggggggcagtcaaatcttaaagctccaaaatgatctcctttcactccatgtctcacatccaggtcacgcacgctgatgcaagaggtgggttcccatggtcttgggcagctccacccttgtagttttgcagggtacagcctccctcctggctgctttcacgggctgatgttgagtgtctgtggctttcctaggcacacagtgtaagctgtcagtagatctactgttctgcggtctggaggacagtggccctcttctcacagcttcactaggtggtgccccagtagggactctgtgtggggctccatccccacatttcccttccatactgccctagttgaggttctccatgagggccctgcccctccagcaaacttttgcctaggcatccaggcatttcagtacatcctctgaaatctatgcaaaggttcccaaaccccaattcttgacttctgtgcacttgcaggttcaataccacatagaagctgcaaaggcttggggcttgcaccctctgaagccgtggtctgagctctacattgccccctttcagccacagctggagcagctgagatgcagggcaccaagtccctaggctgcacacagcatggagaccctgggccctgcccatgaaacctttttttgttccaggcctgtgataagaggggttgccgcaaaggtctctgacatgccttggagacatttcctgcattgccttggtgattacatttggctcctcattacttatgcaaatttatgcagccggcatgaatttctcctcagaaaatgggattttcttttctatcgcatcgtcaggcttttatgctttgtttcccttttaaaactgaatgcttttaacagcacccaagtcacctcttgaatgctttgctgcttagaaatttcttcccccagatactgtaaatcatctctctcaagttcaaaattccacacatctctagggcaggggaaaaatgccaccagtctctttgctaaaacataacaagaggccaggcacggtggctcatgcctgtaatcccagcattttgggaggctgaggcttgcagatcacaaggtcaggagatcgagaccatcctggctaacatggtgaaaccccctctctactaaaaatacaaaaaattagccaggcgtggtggtgggcacctgtagtcccagctacttgggaggctgaggcaggagaatggcatgaacccgggaggtggagcttgcagtgagctgagatcacgccactgcactccagcctgggcgacagagtgcaactccatctcaaaaacaaaaaaaaaataacaagagtcacctttgctccagttcccaacaagttcctcatctccatccgaggccacctcagcttggatttcattgttcatatcattatcattttggtcaaggccattcaacaggtctctagggagttccaaactttcccacattttcctgtcttcttctgagccctccaaactcttccgacctctgcctgttccccagtttcaaagttgcttccacatttttgggtatcttttcagcagtgtcctattctactggcaccactttactttattagtctgttttcatgctgctgataaagacatacccgagactgggcaatttacaaaaaaaaaaaaaaaagaggtttagtggactcacagttcctcttggatggggaggcctcacagtcatggcggaaggtgaaaggcacatgtcacatggtagcagagaacagaagagaaattgtgcagggaaattcccctttataaaaccatcagatctcataagatctcactatcatgagaatggcacaggaaagacccaccaaatgattatctcccaccaggtctctcccacaacacctgggaattatgggagctacaattcaagatgagatttgggtggggatgcagccaaaccatatcaacatgtaaagtaaagtgcctgttattatgtggctaagtgttgtgaaatttaggttttaatgataggcactgcatgtggaagctacagcacaaatgaaagcataattttttttatattcagagtacagaaagaaggtctggtcagccttgaattttcctcaggcaaatatgaaataccacagtgttgatggcattgtctctgaatcttacaaaagatgggagtgcaaggagctgtgcaggcatcagaatcaggctgctgtgacattattctgcccgcatatattattttagtgatttttgtgtcattgttgacaatagactttgtcagtcactgtggccttgctctcttaatggaatatgaaacactagttctagagaagtacttagcttgcaggcattacatcagaggctgaagcaaaacctgacagcaacatctctgcaagtggaagaaagaataaaaactaatatttcctgagttcttattgtatttttttgggaaataggtttggctgcgggtgacagagacacattataatcatgacttaaaatgggaacatattcctgtctaacgtaaaagtctgggttgactggtggcttttgtggtattgttatgggggctgcattaaagcaggggtctggactccctatcttttgttgctccaccatgttgagagtttagctcttgatccaggatggttcattcctatgttctcatcccagcttcaggaaaaagagaagaggtcaagggaagaggattctccctcttccattaaaggcatgacctaaaggtatatcgtttctgattacactccattggccagcatttagtatcatgacaaaacctaactgcaagaaatactgagaaatctagtttttattctgagtggccatgagtatagctagatgttccactaataaagaagaaagggagaacagatattgggaaacacataccagaattgtctattccataattattatgtgtcaagctgtgctaaacacttacaaacattgtcttacttaatgctcataacaacactgtaatgctgtttttacagaagtattttgagacacaaagaggttaagtctccttaagtcttgagacagagagacgttaaataattgtcttaaggtctcagaggaaataagtggcatagccagaacttgaacccaggcactctgactttagaaccctgtgctctgggccactgtgtaatccttgcttgctcattatctcccttaggccttgatgtgctctactagatgagattgtttaaaagcatcaaggaattaaagatactttataaactgtttattcatggcttcctcttcaaggcagctaattgcttccattctaaaattcctatcttatttggtgtaaaatggtgttcagtacaatttggtccagacaagataacacaagaaaaataatgccacacaaatgtgacaagaattttaatgaaagcaattcctgatttgaaagaaatgtgtctatgtgatgataaagcaaaaagtctttttaatacatggaacatttttgatgatgggatggaaaaaaacattcaatatatcactagaatacagaaatgaaaagattgtatcattcaacaaccatcaagatagttaatcttttcagtctttacaatttcaactacatataggtcagcaatttatatgttaatataaatgtatctatagagcaacaaggaaaattaaagaatgtgaagctgttgtagatttggtggtcagagaaaaccttccctgggcaagcagcagtaaaactaaaattaaaaaaaaaataagcgggagccagccagattaagaattaagttgtatgtttatcagtcaatataggttaagtgatgctgcagtaacagctccaaactcttagtggcttaaaacaacaaagatttctcactcatgccacatgttcataacaggatgtctggggactctacttcatggcattttcagaccaggatccagacttgcagagcagacactatttggaacattgtcattctctatggaaagaaaagggtgtgtggtgaaccctgcccttgattttaaagcttttagctgggattacttaccacgtttcattggccagtgtgagtcacatgatgacatctaatgccaacagggcagaaaggtgcaatcccaacttgctttcagaagtaaggagaatgggaagtatttagtgaacagataaatgactactgttttgggtgatggaatgtggagggaaggcattcccagctgaagaaatagcatgttcaaaggccctgaagtgggaaagaacttggtatatttatgaaactttaagaagaattatgttgctgaatcctatctcctatctgtagacaggagatgaccagagggaagagggagcagattaggcagatctttacaggctatgggaaagaggtataaatttcattaaaaatataaaggaaaactactggttggttttaagcagaggaaccacatgatgtaagaaatattttaaaagagtattgactaatgatattgattattccatggagagtagattggaagggaattgaaagtagggacacctaataggcaccttttcaaaattctaagtgagattgcatggtggttccagtttaatgcagtcttatttgaggcaaatattccatctattttagacattttttaaattattaattattatccatttcaatctccttcccatatgcctcaaattcatacagcacttcaagccactgcagtgagccacagggaaggaataaaggttttcttttcctcttcttttacttctttttctcttttctcttcccctactaaggatctgtgcctgcttatgttgaaggaaaggaaagagaaaagttatgcttcattgcttgaaatatttggtgatgggacaaagaggtctcctttctgtcgtcattaccatttctccatatgaaactgataacagaaggctgtgatatcttctcactctgtttaatccacatgaatgttcaaagagctgatattctgcctccaggatgtttgtagggtaggagacgcacaatcccaagcagggttccttctgttctggctccaaggggaagtgaggctgagaggagaaatgatggataatgagaaagtgatgtactcattagaactgaataatggtttcaacagtgtttaaattcatgattttggatataatataatttctagagataacaacttccagggtttcttcatgagagtgaatggtgcacatggacaggaaggtcaaagaagatgaccaggtcaaagaactgaaagcccagggagttggatgtgttatgcccaggaatgatgtactctgtaagaaatgaagccaagtcaagggtatatccatttcctgtggctgctgtaacaaattaccacaaacttggtggggacttaaaagtgcttagtatggctgcctgttgcaacacatgagtcatggtgtgtcatttgtctccttaactaacataaagggtaatggtaattcttagtagatgttttgtttagactcatttttttcctcaataccagaatgcctagcacagtgtaggcgtactataagtgcttgttggatgaatgagtgagacatgaagtcaaagattttaaaaactttgctctacagtttgaaaattctctttttatgaatctatcatcaggctgagaaataaatgacctggttcctgattccatctgtactgcttattatttttaacatgagtcttacaatacctcacaagctagtttgaaagatcaaaagaaataataaatagctttaaatattcaactgctttattacctagcatgaaattggatcctgagcagtatatacaataaactaaggcctttgttcctgcctttgggaagatgctagtctagatgggcatgacaaagtttaacaccacaaatgtaaaaagatatggtataaaatgtgtgggatgattctcaatttttttttcctagaacatagacattctgtgttgaagaagagattggctcagtagcaccaagcaatgacatgtctgtgaagcatttaagtgagaaggaacctgtcttctggagcagtgttttacaaatttggcaatatattggaataaacagtgaagcttttaaaaatcccgttacctaggccacatccaaagctaattatgttagaatctgtggaagtgagatttgcgaatcagtatttttaaaatctttccaaagtgattccaatatatagccaaatttgagactgaatctccaaagctgtgcttctccaactcaaatcacctgaaaattttgttaaaatgtaggttctgatccaacagggtctaaggcagtgcctgagattctgcattcctaaaacgttcccaggtgatgctgatactgctggaacaaggaccacacttggaacagcaattttctaaaggataaatatatcacatgtcaggtagtaaaagaagggacatggaacctatgtaccaagcagcatgctgggaactttacatttatcatctcatttaatctttaaaacaatcatgaaggaatattattactctcattttagaaatgaagagactggggttgagtgggtaaatcattgcctgaggctggacagcttattcatgatggaacctggatttaaacataggcatgtctaacagcaaagcccataggctaatagaaattgttggaaactttcaaatgctaagcagaagcttttcgatgtgaaatggtaggcagtctacagccataccactctgaaagcacctgatctcatctgaaatggtaggcaatgtctttattacttttcttaagtgcatggagattgtgcctacaatgatgctgagtttgatttcacactcctgcctcaagtagtatatataggcaggtaaagaaccaggtactgtgtatgcctgtaacctggggccatgctctctagtgttatggtatcaaagatatcctagagaagttacagtagaatgagaataaatactaatagcaaaataatagtgctggaagagaatgtcaaaattcaaaagtaaaacacaaacattttatttttcagttactgatatcaaaggattgttgcctctggagggagaaattgtatttcctgaaaatatttggttctaactccttgattcaaatgtccttccaaatgaaaatatctcttgattaaagagatgggaattgaaactagcgacaccaaataggcaccttttcaaaattctaagtgagattgcatggtggtccccagtttaaagcagccttatttgaggcaaatattctatctattttagacattgttttagacattgtagatatctctgctcctgtttgtttttttaagtgattttttttcccctcttctttcaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgtgagtttcttgatttttcatggaaagtggagattgatgactgaagggattggagtggggaaggcaaaagagaaaaagagtattttaagtttaaggatagagagtgcaggtgaaattacagcccaatcacaggcttagcaatgccttggcagggctctggggtgtgtgtgtgtgtgtgtgtgtgtatgtgagagagagagagagagagagagagagagagagatacagaaagaatatttttttaaaaattgcaaagcattgtaaaattggaagcctcactgaaccatatctctttctttttaatcattattaatattattattttagggacagggtctcactctcaccctggctggagtgtagtggctgttatcatggctcactgaagcctcgacctcctgggctcaagtgatccactcatctcagcctccagaatagctgagactacaggcatgcaccactacacacagctaattgaatggcagggtcttgctgtgttgtccaggctggtcttgcactcctggactcaagggatcctccagccttggcctcccaaagtgctaggattacaggcatgagccactgcacccggccactctttctgtatttcaaaacttcccctgagcatccttgtctcagggcccctcttggcttcacgtggctcctcagagggcatagataatttccctgagacattcttagacatttgaggtgactggcaatatggttctcacatgttcagcctgctctgcacatcagctgacaagcaaagctggagtacttcccgaatttcctccaaaccgaatttcctccaaattctttctcattccttgagaaagaatgaagggagagaaccttcccatttgcctctctgtttagcctgtgggagtgcagtaagcacaaatttcactttgccaacttgggtgaaagccaagagtcattgttttctcagttcagttaaaccagtcttagtctgattcagtctctactgctcccctccttttgagaaatttcccctgaatccactggtatgttttctccctcccagtgtctgtctcctctgctctgggaggtgcctcataatctcatctcaaggcagctgagtgttcatctacctttcctgtgaatccaattcattggtttttgttttgttttttgcctagttaactcatcctgttacagtagtttaggggctgtcttgggaggaaaagtaaatagtgagatagtagaagtgatctttcattttcatcttctctaaatgaggactaccgttctgttgaagacgcctatattcagtgcttacatttttagccaatgttatgttccctgtactgtttcacaaaagtgatcctgaatagagcaattcaaactatgttttaatactggattgagataagtagggttatttttgtgaatacatagcaggtatatatatttatggggtacatgagatattttgatacaggcttgcaatatgtaataattacatcagggtaaatggagtatctattacctcaagaatttatcctttgtgttacaaacaatccacctatactcttttagttatttttaaatgtaaaattaaattattattgactatagtcacccagttatgctatcaagtactagatcttatttattctgtctaactatttttatacctgttagccatctccacttcccttgacccccactacccttcccagcctctggtaaccatccttccactctctatgtccatgagttaaattgttttaatttttagctcccacaaataagtaagaacatgtaaagtttgtctttctgtgcctagcttatttcacttaatataatggcctctattttcatccacgttgttgcaaatgagtggatctcattcctttttatagctgaatagtactccactgtgtatatgtaccacattttcttcatccatttatctgttgatgagcacttaggttgcttccaaatcttggctattgtgaatagtgctgcagtaaacatgggagtgcagatatctcttcaatatactgatttcttttcttttgggtatatacctaggagtgggattgttagatcatatggtagctccatttttagtagtttaaggaacctccaaaccgttctcctagttgtactaatttacattttcaccaacagtgtgtgagagttccttttcctccacattctcaccagcatttgttattgcctgtcttttggataaaagccattctaactggagtgagataatagctcattgtagttttgtcatgcatttatctgatgatcaatgttgttgaacaccttttcatatgcgtgtttgccatttgtatgtcttcttttgagaaatgtctgttcagttcatttgcccattttaatcagatgattagatttcttcctaatcagattattagattttttgtagagttgttcaagctccttatatattctgattattaatcccttgtcagatgggtactttgcaaatattttctcccattctgcaagttgtctcttcactttgttgactgtatcctttgctgtgcagaagctttttaacttgatatgatcctatttgttcatgtttgctttgattgcctgtgcttgtggggtatttctcaaaaagtgcttgcccagaccaatgtcctagagatttttctgcgaagttttcttatagtagtttcatagtttgaggtcttagatttaagtatttaatccactctgatttgatttttgtatgtggtgagagatatgggtctagtttcattctatgcatgtggatatccagttttcccagcaccacttgttgaagagactctcctttccccaatgtatgattctggcacctttgtggaaaatgagctcactgtagatgtatgtatatgtttcttcattttttattcggttccatcggtctttgaatctgtttttatactagtaccatgctgatttgtgtatgctatacagcataaaaacatagaaattatagttctgtggtataatttgaaatcaggtaacgtgattcctctagttttgtttttgctcaggacagctttggctattctgggtcttttgtggttccatgtaaattttaagattgttttttgcagttctgtgaaaaatgtaattggtatcttaacagagaatgcattgaatctgtatattgctttagataaacagttttaaagaaacgaatcttttaagttcttttattacttactttggatacgttattttgatttacttaagcaattattctcaattctttatctcacataaataaatttttcttagtcctttctgtcatcagcaaacttccttctccagatctgggaggatgaacagtgatgaaataaacaatatatggatttcaacataatcttttactgatttgaaggagctctttatatattctacgtacaagctatgttggttacctatattgcagatatcctctctcacctcctgacttggctttccattgtcttaatggtatcattttatgaacagaaatctctactttttagtagttccatttgttaattttttcctggattactagagggatttttttctgaatcctgttgaagaaaactttccctaacaccaaaatcatgaaaatattctcctatgtgatgttttataattgttattgtcttaccttttatctttaaacttataatccacctgaaacttattttgtgtgcatactgtgaattagaaactgatttttatattttaatgtgggaattatgcagtggctgatttgagtatcctagataactctattcaatgatgtttgttaattgcattgtccaagtcttccatatacttagtgatttttaatctgcatatccaatcagatatcgagaaaggtatgctaaactctctcaataataattgtggatttcttatttatccttttagttttgattatatttgctttatatatttagatttactacagagttaccctttccactgctctttattctttgctatatctctatgcttccatcagaataatttttcttcttcctaaagggtaccctttagtatttcctttagtgtggctttgctggtggtgaatactctcaatttttttcttagcatggctttatttcactcttaattttcaaatgtgtttgcactgcttattgaatcctaggttggatgttattaactttcagtaatttgaagatcctattggcttctgatttccagtgtttttattaggaaatcagctatcagtatattattgttcctttgaaggtaatatttttaaaacgtttttaatattttcccctttttgtcgtgttttcaacagttactataacaaacctatgtctgattttctttgtatttatctattttgatgttcctagaacatcttgaacctgtacattaatatcttttgtcatatttgaaaacttctcagggaatatctctttagatatttcttttcccccattatctgtctcctctatgccaggtagtcaagatatgcatcttagtaatattcagcatcttttagatatctttatgctcccttctgtatttgttatccatttacatctctaaactcagtttgtatattttgtctgacctatatttcagttcatgaatcctgcctttgtgtctaatttgctattaaacacatccatttaattcttaacttcagttactgtgtttttcaggtttagaattttcattttgcctctgttatgttttctaaccgtctgctgacctactcatttttttcttgtaatttcttgaagtaattatttggaattatgttaaaatgtataaattatagatctgttatctgagtcccctacgggactacttctattgtttattgtttcttgtggttttggtcatgtctttcttcccgtaaacctagtggttttttattgatggccaaaatatatgaagaaatggtaggacttaatgagactctgtataatatgcctctattgagaatgtacatttttcttctgaaagggaattaggataaggctcttgcatatttaagattaccttaatcaagtcaaggattgaactaatttcaaaattgggaccttggtccccatgagggctgatctgtttctggatcacataaactcatagggaatactccttcagagactcataacatgcctattagataagagaggcaattggttttatattttatggatagtgtaaacaagaacgctaagagttagatgtgtgttagtagagttgggatgagtttaaaagttttggggttttttgtttgtttgtttgtttgcttgttttttcacacagctcttttcccaccagattctgccaagatgagattttccattttagagcaatgaagaagaaaattgaattttaactaatgactgatttgctagtcctcaactatggagtctgaggatttatgggggaatttctcaataactatttctctaaatttataaaatactatttgatcgttagtatttatttttgtcatttatattccatgtttgttcaccctcttctttacacccaaggccctcactcacttagacaacagtaaccagggactgtgactcaaaaactcttcaatcaattataagtcatcttaagcttctgtaccgggagaagaattttatctttaacttctaaatatcactatctaaatatatctatctaaatatcattacaaggtaattactgaggtatacttttcaatacaagatccaaggagattgtgtattcacacattttgccatcaactaatctgctagttagtacggatgataactagaggcctaagtcactcataccgctctcctacattttatcagattaactttaggttattttaatgagaaattaacttttaatataagtcagtggaattcggagattgttttagaagctagcctacccaaattaatataaccctttcctgtggtttttcccttaatacttacatgctctatattttacttatttatcttattatttttctttctccactagaatgtaagggcaggagtttttatctgtactgttcactgatgtagttctagtgcctaaaataatgtctatagtaggtactcaatgaatacttgttaaatgaacagatagatgaatggataaacaaacaaatgaacaattgaatggatgaataaatggttggcctctacttaaagtatatcaggcttaagcaagtggaacaaatgtagaacaattgtggttttcttctgtcaggagcatgggattaaaaagaaatgagccatgccaaatgcatttgccctctgaacaaagtaaattcctaactgtcacgtaaagatgtaacataagttgttgtcagagggtataagaataaataataacaaatcaaaacttccgtgtcttccttgggacatgttaatgcattgatacagaacttctgaatcaattgcactaattttattggtgtaacaataatttaatagacccaaatatccacctatataattaatccattcattaacccatccatctatctttcccacacatttattgataacctgttaagtatactagggactaaggatacaaagttgaataaaaaatggtctatcttcaatggttacacagtataaggaggaagatgagtttattattttattcataaatttctgtcttgatgcgttaaaatgtcttaaggaagaaacagctctttcaatgtgtgattctaacccttctatgacaacaacttgtcttttagttatatccttctgtgacagctagaaatttacatgatgagtatttaatttgatatatcaaaattacttctcatttttaaagctgaaaatcagagtacattacttctccaacattgcaactgttagtctgtgtgatattagagacttaaactatatctcagtattggaagtatcttgtttgctattcatggagtggttttcaaaacggaagcataaataatattttattggcagcaaacactctttgtttattgtgagagaatattgcagccccactgagctgtctctatatttaatagaccataaaattgaaattcccaccctgacctctaagagatgagatgagtcagaaggtgactcactctctaatcagttggaagtaaatgacctttattgtcatttactttggattgggtaaaagtaaagagcttttattgctttagcactgaaacgattacagcaaggactgacagaggaaggttacctgttataatgggctgagcaggccctgacattttctccaatcccttctgattccaacaagttggctattgtaagcctagtttttaaactctataaaaaacatgataaaagggaccttgacacagccagttaattcatttttctatcttaataatacctacaaaattccacattgttatgttagctgaggcagttgcagtccaacacaaagacagtcataatgatcattttttctaattagtacccaattgaattcagaaggccccaaagataaaagcaacatgagttggaacaaaacatgaaatattttttctttttttcttttttttttgagatggagtcttgctctgtcacccaagccggagtgcagtggcgcaatctcgactcactacagcctctgcctcccaggttcaagtgattctcctgcctcagtttcccaagtggctgggactacaggcatgtgccaccacacccggctaattttgttgtatttttagtagagatggggtttcactgagttggccaggctggtctcaaattcctgacctcaagtgatccacccacctcagtcttccaaagtgctggtattataggtgtgagccactgtgtcccgccaaaacatgaaatacttctaatatggcattgatgggcagatcttatattcatgctatgttgcaacatattaccgtgctatatgtccttgtgagaatctttgtctttttaaattaggaagatcctgatgatatttttatttttgattgattggtaatgattactgcaatggataaaatataactgaaatagatgaaaaatactgagtgtttatcagtaaaatagatttcaaaaaagataatactgatggatggaacatacacagagtgcagaagacgatgtatacacctttgttataagaaagagaaatacagcccctgacatctggaaactgggctcacactgacaaacctagtcccttgatgttaagagctggtcttgcacttacaggtaggccatactgttatcctgttggacatcaagcagtctcagggtaccagaatcccacaagatcattctacaacaataataaagtaaacaaaacaagaacactttgtaatcttatctaagcatagatgaaaacaaggtgactgttgaaaccgcaaattaccgaacatccccatttcttgactaatgtgaataacctcctactttcttaccaattagagctttagcctagcattagtctgccatccttctaaataaaatttatcaagataccaatgttagaattgtccccattctctgacatcgcttaatccagagaaaatccctgctccatctaactctcccgaaaattactaacataaacccaaatcctatagtaaatcctttcaagtgccctcttactgagactctccatgattcctcatggtatgtggagttttttttttcattattatgggcaaaaatctcaacatgtttgtccataggtgggacgagcatctggtcatctttggcctgatgagtgagtattggtaattgccacataggtcatttcaaaatcacttctaatttagcaaattttcatagtgcagctacaagggaaagattcatattggagtagtcctacatttacccaaagatttcttgaatggcaagaagctatttttagtcccttgacatgctattttgcatcaactatcaattatatacaagtgcctccacgcttgtatagaatgaggtgttcactatgagtatggtaccttaatagctatataaactagaaagatttttaaatctaaaaatatagtacatatccaaggtactctataatacatatagtttaaacaataataaaaatagcccctgtgtattcattacccagtctaagaattagaacatcttgttttgtatttttcattcccttgctttactttatggttttactgcatttggatgtgtctctaagtaacatgttttctagttttgtatttttgaatattatggaaatggaaatcatactacctgtattcttttgtgatgtttttatctcaacaacatgtttgtgaaatacatccatgttcgtgtgaataacattacattcatctacactgttgttacattcccttaatgcatctattttctggtcaacagacatttagattgtttcagtttataattttaccaaaaaatgctgccatgacattcttatacatatggcctgacaaacatgtatgagtgtgtacactcaatggtgggattcttaaatctgtggatcatgacctattggtaggtagtaactagcattaaaaacaagtggtgggatttttaatctgtggatcatgacccattggtgggtagtaactaacattaaaaaaaagtggagtaaaaagtgtcagtatagatatacatatatatatgtgtgtgtgtgtgtgtgtgtatgtgtatacttatacatgtgtgtatttattttctgagttgtgacataaaatgtatttcttattgtgacctctgccaaaaatgcttgagaagactacggcagattgtgcatctgggaatgaaattgcacaccaaacggtatgagcattttcagcttgacaagataatgttaaattcttttttatagtggttgtaacaatcaaaaccccactagcattgtataagtgtttcctttacttcatgatcttaccaacacttggcttcatgaacattttttattttttccaaaccgatagatataaaggaatatctccctatagtttcaatttgcattttactgcttaagtatgaggttgagcagcttttcatatatttattagctttttgtggttctttttctgtgatatgagtatttatgtgtattgcacaattttattttaggtgctggtcttttccttattaatttggaggtactctttatgcttcccttcatctctaaatatgtttttgctttgaaggctattttttctgttattaatacaattacatcaaatttcttttggttaatagctgcatacatgtttttccaacatttgactttaaacctttctgtgtccatatgtttaaggtgagtctcttttatgtggcatatgtattattttaaaatatagtatatgttatatgtattttaatacttgttatacttatatgctacatacattacatatgtgctgtatatacatatacctgatatatatactatatgtaatttttaacatttaatctcataatattgtttcttaaattatagagtttagtctgtactcactgattactgcaatatttacatttatttctattatcattgtgattcctgaaatatttgcatttatttattttatctgtagattcattaaagtgtatttttctcatcccatgttatcctttctactggtattcgtattatatgcttttttcattttcagtggttaccctggaaattataacatttatatttaactttgcaaatcaatagctaaaagaaacttggtattcttgaactctaaatattattttcctggctgatacataatttttgtcctttgttttagacatttcttattgtataatccaacaatttatgtcatctcatttttctttataaatcaatgtttgtttagatttttatatattttatcaatttcattgttcaccatttctttttatacctcagacctattttacctctcctgaagtatagtctttaaaagttcctttagtgagaatctatttggtgataaattatctgttttcattatgttgaaaatttctttatttcatcctcattcgtgaacagtgatttctgtggatatgcaattctagattgatagtattttctcccagcactttgaagatgtgtcattggtttctggatttcatcattgctattaaaaatcaactgtcatgctaattgtggttcttttgtaggtttccttttgccttcctggctacttttaagatgttccctttgtctgtagtgctctatagtttcaccataatgtgtctaggggtttcttttcacttttcctgcttggaaaggaagaaaggaataaatgtacaccagcatcttcatatggccaaggtccttgtttgtcttcttcacctctgtattcttagccttagcccggggcatgacacatagtagaaatgcaataaatatttgctgtgtaggccgggcgtggtggctcacacctgtaatcccaacactttgggaggcagaggtgggcggatcacttgaggtcaggagtttgagatcagcctggccaacatggtgaaaacccatctctattaaaaatacaaaaattagccgggtgtgatggggcatgcctgtagtcccagctactcgggaggctgaggcgggagaatcgcttgaacctagaaggtggaggttgcaatgagctgagagcatgccactgcactccagcctgggtgacagagtgagattctgtctcaaaaaaaaatgctgtgtaattaataaatgtataaaaaaattgaattagtttccttatgaataatagaaaggaactaatatcttatctcagagtatctaataagcatatcttgttgcagatgtctccagcagttaatagaaaataaaggagcaaaatgaatcttttggtcattattcttttttaagataagattacctattttcccctgtaaaactatagataatttaatttgactttacattcatataagcttccaagtgaaggcttgaaaagtcccagaggtttagtgttaaagaaaaccaggacaaaacaaaccctgaactgtcagtaatcattattcacaaataagtatagcccactgtgattttaatcaggcccattcttcagagtatgacttacagtgcataaagtctatgtcaagtcttgtgtttttcaaatactagattgacatgacagagagggatataaattttatagtgggtgggatttttattttcttttgtcttttaccccttctgtattcttaccactccaccctcaacacacaaacatgcacacgcacacacacaccccacaatcacagccaatcatatgcaatgctatgtttgttattccttggactctacaggttttcacccttcctcaaagccctgttatagttgacaagtatgagttctcttcagacaatttttccaagtataaagcatgtgggatttcaatacaaatcctgtctctgacataatacctttataactttgggcaaattgtttaacctatgtgagctttagtttccttgtctgtaaattggtaatggtaatagatacttcattgcttatagtgagaattagagataccgtatataaagtgactagcctattacttggtgactgacatgcactcactaagtattagtttcctgttctaccaagccttctgtctgcctcctgacaagacgtgacacctgagagggtgacaaaggcataatctcaacaatctgttctggtattttctctgaaatgacaaatgactcaagtgcattatctgagttgaacaaatacaagacttatagttattattctccaagggtagcaagaggtaatgactaacaattctgggaagatcttatttgtgttaggtgttggcagctctaagcatgcatggtaaaagtgatatggaggcccatttcctggagaatgtagactggatgtgtccactttcttctgtcacacatgaaactgctgtcagtatgctatctactccatctcacatccaaagaacatatcaaaaaaaaaaaaaagatctaaggccttggcatgccactatttagcaatttttagtcactgaactatagtattcccccttgttcttatttctttttgtgtactctttgcctcctgcaaaagttaaaaactcttcttttttgtaataaaacaccagagagcaaatattttaggctttgagagctatgtggtctaccgctgcaaccacttagctttgtagttgtagcacaaaagcagccaaagacaacacataaacaattgagcatggatatctttcaataaaactttatttatatgatcaatgaataaaggactccctatttaataaatggtgctggaataactggctagccacatgcagaagaatgaaactagacccctatttttcactatatacaaaaattaactcaagattgattaaatatttaagtgtaagacctcaagctatacaaattctagaagaaaaccaaggaagtatcattttgaatatcagccttggcaaataatttattactaattcctcaaaagtaattacaataaaaacaaaaattgacaaatgagacctaattaatctaaaaaattttacacagcaaaagaaactaacagagcaaacagacaacccacagaatgggagaaactatttggaaactatgcatccaacaaatgtttaatatccataatctgtaataaagttaacaagcaaagaagcaaataatcccatttaaaagtgggcaaaggacatgaacagacccatctcaaaagaagatatacaaggagctaacaagcatatgaaaaaaatattcatcactaatcatcagagaaatgcaaatcagaagcacaatgaaataccatctcacaccagtcagatggttattattaaaaagtcaaaaaattacagatgctggtgagtcgtggagaaaaggaaatgcttatacattgttggtgggaatgtaaatttgttcagccactgtggaaaacagtttggagatttctcaaagaactaaaaacaaaactattataccattcaacccagcaatcccattactgggtatatacccaaaggagaaaaaagtcattgtacaaaagcacatatacttatatattcacagctacactattcacaaaagcaaagatattgacttaacctaggtgcccatcaacagtagattggatcaagaaattgtggtacatatacaacatggaatactatgcagtcataaaaataatgaaatcatatcttttgcagcaacattgatgcagctggaggccattatcctaagcgaattaatgcaggaatagaaaaccaaatactgcatgtcctaacttataagtaggagctaaacattgggtacatatggagataaagatggcaacaatagatactgtggactcctgggggtgggggcaagggttgaaaaactacctattggatactatgttcagtacctaggcaacgggatcgtttataccccaaccctcagcctcacacaatatacccacgtaacaaacctgtacatgtaccctattaatctaaaataaaagttgaaattattttttagaagaccctatttatagaccctgaaatttgaatttcatatacttttcacatgtcattaagtatttttattttgatttttttcaaccatttaaaaatgtaacaatcatttctagcttgcaggctgtacaaaatagatgatggggtgaatttgacccatgggccatagtgtgcctaccttttcccttttgtttctgaattttccttattcatcttcttacaacctatgcaatttcctgagttgaatattagaacaaatatatttctatgttaacttatcatagtagttttctattgccaccttaactattactacagcttagcagtttaaaacaatgcaaatgtattatttcacagttttggagctcaaacgagtttgactcgtttctctactccaggttctgtaaggctgaaatcaaggtgttggctagttgagttcttttttctataaagagattctgggaagaatccacttccaagttcattcttgtggacagaatccagttccttgtggctgtcagaatgaggtgctcatttccttgttgactgttcacggaaagccattcttagctcatagaggtctcactttccagtcattgcctgtggacctctacacctcagagctttctcagcacataaaatctttctcatatttgcaatctgactttccattctgcattgtctttactgacttcctcttcttcctttgtgtttaagggcttatgtgattgctttgggcccatgtggataatctaggataatctcactattttaaggtcagctaattagtaacctaattccatctgtaatgtctgatcacatcagcacctggattagtgtttgactgaatagccaagaaacaggagacatctttcgaatttagaataccacaattgtcacctggatttccaacactgtgatacataagtctatagatcacttgaaatgtatccagaaataacttaacccattcaagcttttggttttggtaggttatatcttagatttgaccgtattccataagcgtattttatatagttactgttatggagcttatccaatagtctgggcttctcaataggtaatataaccacttgggagtaaatctatggtagacaaactatggtcttacctttcaatgaatacttttctccaaggttaacattttcactttttgccagtagtggaatggtgtttcatatataatttacctttgcctcagattccgaagcagatttcaggataattgctgaacaagcagatttcaggataattggggaagaaggttgacatatttttcaagagtgacttttctatttgagatccagctattgattttcaagtccaataagttgctgaatcaaatggatataatattctggggcttgaaatgcctatttgactctcagttgcttttcctcagccaccatatcagacatgtcaccaattcttactgattctcattctcagtgggccaagtgtatgtgtctttccctttactcctcacctccatgataccctgatttgcatcttcatcattttctatcctctttattgtttaactttctaatttgcctgcctacctctggtttctctcttcttcatatatttagccagagattatgtgattcaatctgaactttagaaaaactgctagaatgacattccacctctttacctcagcattcaaatatttgaccccaaatcctaccttttaactccagttttcaatagaattctccacaaatcctttaccgtagttacatagtcctatttactattttcagaacatgcccatagaggttttgggacaatagtgctcacctaatcagctaaagccatttcttaatttttaattagaaatatatttagtctaccgaatgacttctacagctgttaaaatccttgtgatatgccagaaaaggacttttatagcagcataactactataggttgaattccaggtattctaattcattccacaaatatttcctgagtgccagttactgctcctggaaatggtgaacaacacagccaaggtccctgccctcatttcactgatgataataagaactatgagaatatgaaaagaagggtaatgtgttaaaattatgagagagtagtcattcatttgaaaaacattaattgagatcgtggtctgtgaaagactttcttgtaggtactatggaaaacaaaagatgaagcagacagaaatcagttctcagagcatttacaacccagtcgaaatgagagggtagaaataatactgaaggacgctataagtaatgggagaagtacagacaaagaagaggattataagcatttcaggagggaagatgggggtgatttcatgtagccattgcaggtagggtttaaaagatgggtgtgactattcaaggatccttctttcccatctttaacattgaacttattaccaaatccaggcaagcacttccaccacctatgatctgaatttattactcctcttttagtcttaccattgccctagcatgggtgccatcatctgtctcctggactattacaatggccaacctgtctctttatcctattctctcatcagtctaacccactgtacatgttatatcaaagaatcttttcatcacagagatctgatcataagtctgatcacagagtctgatcatgacctctttttcattccaaacctttacttgatccctattgcttgcattgaagatcacttatccactaatgcagtggttaagaacttgagccccaggtcagacttattgggatgggatcctggctctgctacttaccagctgtgtgatatgaggcacattattttattgctctaagtcccaatttcctcatctataacattaggataatagtgtttacataaggttgctatgtggataaaaatatatgaagtatgaaccgtaattagcaagtacctagcagatagtaaacattcaattaatactggctattattatcaccataaaatactccagagattgagataaactttataaataatttgctgttttcagtttattagggatttttgagagttaattatgtggctaaataattgaatttcaatgctcttcccttttcccttgagtaggcagctaaggattataactggtgagtggttttttgaagaaaaggcaaaacgtttcaagcaagtcaatgttctcggcactgatgttgtccgacagtccattttaagaagaagtccaggtaattaaagcaattatgtggtttcacaactgttttcatctccatttggctaactaaataacttctctatgttatgtagttaatcagcataaatgagtttcttgaatcccttagggcatttcacaacttggtagcatgaaatctagatacgtaattcatacaagacaagaagaagtcagtagaaaacaaaattcacaatgattttccatatatctcacccactaagattttcaaagaaaccatttgtctccatcatagacagttctctttctgaatgcatccaatattttactaaacacttaaagtaacataaaacagatgaattaaatgattcacattgtgaaagcaatccttgatttttcaacaatatttatttccgatttcctttcaatgttactttttaaatccagtggttctcaatcaaagattgataatatgtaccttgtctccctccctcaaaatgggagcatttggaaaggcaaggggggcatttctggttgtcacagtgactggtgagtcaatggcatttggtgggaaggagccagagatgctaaatggcttgaaatgcatagtcttactgaatgaatactggcaccaaatgaaaataacactttaccttgacagtgccttttggtgcattcaaattacaatttagttaattaaagatggagtaaaccttgtgattgggagcatgtttctcgtatatggtgtagtaaaagcggaagaaacatctttcagcctgtttctaggcttatctcatctttcatccagaggagacaagtgcccttgtatttaagtctggcacatatggcgagaaggcttggaactgattccagtggtacttctgggtgtggcactagcaaggaaaggcttttccacataggtcacacagatccgatactacagagagatggtgtggagtacagttagaattaggcaatcagccatggcctcttcttccactcaaaccccagtaccttccagaatgtaggcagttcctcaagtcacaatatatttgcacagatgcccaccctcccaggaagtgtggcttatatgcccagaaattaggacatcatttctacaacctcatgctagaactcagtctccagggatttggagatcttaggagaccatgttcccctgctctaaaaatatcaacagaaggctgatgcagtcatccctaggaaggttatctcagtaaacctcccacagatgagttcaggatctttgtcttcagttaactctagaacactcaacaaattagaactaactgtgtgacagaaaaacttgggatgggaatggcattgccaattattatagacttccttgccctgagctaatctgggaaagtgaaagcagaatataaatttgctctcatttctggccattttgtatgtaaatttctcttctgattgtttgttaatgaggagctgaagaagtacagagccaagagcaaacccgccaggatgcagaaaagtcagacacttcacctgttgctgggaagaaggccagccatgatgggcccaagagaaaggggtaagacatggtctttctgagggaatttttgatctttattccagacacctctgaaatgaagactccttaatttttcaagtttgatgtcacttcaatgacccagaggaggtcagagactcaaacaaagtaacactttcttatcattctcctcaggaaatgcagttttaataattttcaataagtaaataaaagtcctgtctgacctaagcacagaagagttttcctttcatttgacatatccagtcttgcactatatggttcccattacttataagtagaaagtttcatgccaggatcagtctataaagaggtgacaacaatttctgttgtacaatgtcaatactcctcccctccaacctgtgtgctgatatataattttatccaaaataaagatttattaattgagcttaaagcaccatattccctatttaaaattcaggcttccttaagaaaaaaagtcacatttggccaccacagtaacttagttcagtaaatgaatacagaatatggatgccaagtactgagaataggaatgggaggtacataagggagcaagaagtttctttcaagggagaaaagtggatcccaaaatataggctataaggaccaaaaggaaactgcatttttcagtttttgtttctcatgcagctattggccagtttttgtgactgaagtagtgagagttctaatgtgcaccaagtcattttatggtcctttctgtttttttattattattgagatggggtctcattatgttgcctgagctggccttgaactcctgggctcaagcaatcctcttgccttggcctcccaagtagctggtactacaagttgtatgccaccatgcctgcctaactttatggtccttttcagacagcattgcttcattctctcagtagaatgcaaagtgagagggcattagtgttagaagatttatctggctgtacaaaatgtctagggttcttttagaatcttgggctgtcagtaggaatacaatctaaatgtcatctaactcaagcactcatgacaaaccatgttttcattgatgagcagagatgagttggaaagatagcctagagtatcctgtatatcctatcctatgtattgatccttcctaccatcttgagttcatttatcactctttgggtcacccacaatgctttgtgcctttgcaccaccaatcatattgcactctgacaccccctcaacacacacacacacacacacacacacacatgcacacacttaattgtaagcttctttagtggtagaccagtggtttctttgcttctgtgttgcagtatctagcatggcacctgactcatcaaaaacaatcagtggcttgattgaataagtaactcagagcccacaaatgcctctaggagttgtcatttgcagaccccagctcaggcatcatagagtaggttacagaatagtggacttggagataggagacagtaactaactcaccatcacaatcaattatgcaaattctgaatcattgaaaccattgtagcactgggctgagccttagattctgattgttctcagtcatcaaggaatataacatctatttggggagaaaaggtacacacctgaaaagttactaagtataaaagaattgcaggaaaatttaagatggcaatgtgagcttcctaaaagcctttctaaaacagaggagggtgttcaccacaagagatatcctaaggttataaattactgagtacatataaataagcaggtggacaataagtgccagttgagtataggagtcatccagaaagacatcaaattgtacatgagatttgaggaggagataaatggggttcaggatcacaaaacggaggaagagtgactccaggcagaggagataccttaagtagaggacatgcatgaggtggttctcagagcagcataccttgacattatattaagtgctattctcaccaaagaaaaaatgtaattttccagtagattaaagcttcagatgctttgacaatgacactattccaggagtctttgaaacagagacaacatggcagattctattaagattgtgccagtacctttggaatccatgttttcctctagaaaactgtagaatgtaaatgaagtgtatctcccaatgccattacaaaaaggaatatagctttgattttcttattcaagtacatttggaaacacccatgttttgggcacatggtatcctggatcaggactttaagttcctaaaaggctgtttctgcttaaaccccaaataatttagtgaaattggaaggtaatcagattttatccaacatgaggcacaagaataaatgtcatggaagataataaagatgagtttagtcattcgttccacaagagttggttggattccagtataagccaggcatcattctaggctctggaaatctgtcaaggaacaagaaaggcagagtcactgctctcatggagctgcagtctaataagcagctacctcagtttgtccaagaggatcatcctggcttccctctctgagcaaagggagttcaaactctctattctcactattcctgcaaacaggcccaactcagggaatgcatcttctttctcaggtgacagtgctgagttctcagaataggcagtcttttgcttagtagtgacctaccagcaagtggtacggtcttgagagaacggcgtaaccttccccattatcacccttgatactgtattgcagaggcactgggaactctccagaacctctcagccctaaggctgctttattgaagaatcctttattattaaaagtactagaaattgtattcttgaaatgatatttttaaatgctttctttcttatctaattttaaatacatatatataatttcagatttcttcttagcaagttcagatcggcaaccagaggagaaatcataactcccaaaactgacactgggcggagctatagcttggacttagacggtcaacattttcggagtttaaaatcacctcctggttcagacaggtaagagtcatacagattgagcaatgatgtagcctgaggttaaggttgatatattcccattcatagggggattttaggtatctgtgaaatattaccacttggagaactcctaacacataatgtgaaaattcaggaagatattttttagttgatatggaaagcacgtaccctacttctagaattacagctattggaattgcctatgtcacctgcagggatgaaactttatattctggcacttggggctgcagttcaaatggaaatgtacagggcaagtaaatgtttttcattgacttcttgagctttttctatttaagctcctgaaaaaaagaaacctctgagtgtcaaatacattccttgcagcttttaaaaaattattaataattttaaatttgaatttcctcagagactttttcataaatttcacttcctttctagttccacctcttctaactggaggagattatcagtggagccaattgagaatgtcctatccacagatctatcacttgtcaagaaaaataatgagaaacacaaaggatagcccagagcatagtcattttatatcaggcgtgattttctgtatcctattggagcatagtcaagacttattttcatgattagtgtattatcaaagctagcaatgagaaaaaaatatccaccttcatatttcactggtttgtccaattgttaactccctttcgtttgcttgtgtctggggtaattttgcaagccagatagtacaagtagcagattttcttttctccttaggttaggaagaatgcaagcagaattgcattcttccctgtaatccattttagaatgcagaccaaaaaatttccttagaggggacactattttgactattgggttattttttcatggtgactctccatagctgtttcttttgtccctataacagtcctgcatgcaagcgttactttatgtaaaaccatacagaaaaaaaaaattacaaggaagcgtaaagtcatttatcacccattatcaaaatattaatactgtattcagtatttcccaaactttcaagaatgctgatatattcccttttatgattacaaactgttaagctatggttgcctttatccttgaaatagtttcatttgtcttccattgaggtagcttcatgctgtgtcccacaaaactttctataaacatctcattttggctgggcacagtggctcacatctataatcccaatgctttagaaggctaaggcaggaagattgcttgagcccaggaatttgaggttacagtgagctatgatcatgccactgcactccagcatgggtgactgagcaagaccttgtctcaaaaaaaaatgaataaataaatctcatttttgtttttcatagttggactcctgactctgagatagtagtggtcaaaattatttagagacagtaagcaactaatttggtgttctttttgctcagcctcctgggactccatggatgagccaccttggctaacacttaaggctagcatttaagaaaggcaatatatacaaaaagaggaaagacaatgttccttgttttttgtttttgttttttttttttgagatggagtctcgctctgtctcccgggctggagtgcagtggtgcaatctcggctcactgcaacctcagcctcctgggttcacaccattctcctgcctcagcctcccgagtagctggaactacaggtgcccaccaccacgcccagctaattttttgtatttttagtagagacggagtttcaccgtgttagccaggacagtcttgatctcctgacctcatgatccacccgcctcggcctcccaaagtgctgggattacaggcgtgagccaccgcacccggccaatgttccttgttaaagaaaaaaaaaaggctgccagcctaacaaaattagattgtgctattttaagttatatgtcttacagttactcaacaagaataatagggagcatggtctccagtatcagtgcttataccgtaatggactctatctgcctcagtttactctttgtgtattatctactactaggcataaataaccaaaactataaagccatatggacatgcatcaccaagtactggtatattgacccaggagcttcttgttctttttgtaagctgaaagaaagtccctaagtagactttatcttaaattgtaaatacctgaaatggcttacacatagtcagaagtagccaggagtgctttggcttaagcatgttaagaacaatattttgccactaagaaagtgagtaaagatgctcaggagatcaatagagcaaaatgtcctttcccttgaacgtgcatttatcacagtgatgactcattaatggactgccacagtgagatgagttccattatttcaaaatgagtccttagaaaattgaggcaggaggtagcccatcttttcttaacttccatcatctgaagagactgtaagatcccagtctctttggtctattgcctgacccagcttactaatatttcccctttttcccttacaatgcatattttttcatggatcattggtattttcatggagcagctgggcttcggcattcctttttaaggctcacatcatataagagtgtaaatgatgttttatcagatgtgcagttggctttcttttcagtagtttcaaagcaagggaaagtatgaatagattaaagaagccctagcagcctctcagaagagcttgtcaaatggatgttcaccggttgctagggacttgacacatgagacaaagaatatttttaggaaaataaatgtaagctgtagttaataaacaatattattcaaggtagtgatttctaatccctacaaagttgtgatgagctgtcactgtggtatgatttacaagatctctaacttaagtcatgctctcccagaaacagacccctagacaaggatttataagcaagtgatttattattaatcaagtgattccaagagaaaccaggaagggagtaggagagacagaatagagaagaggaagaagctaaacaatggtgctagctccagtgtggtctgaggactcagcctgatcctgtaggagactctagagcataaactatatccctgagctttttccacattgaggagctggaccattgcactcctataccagtcagtcattgaccatggcctcccttgaatagagtctctagacttagcaagtgaagatacaggatgcccaggtatgtatagttgagactaacaactgttttttagtataagtatgtttcatgcaatatttgggacatccttatacttaaaattaatttttttatctgaaattcaagtttaactgcgagttctgtattttatctgacaactcttctataggggtgagggggagacaaactccagggcatttctaggcctccagctccagggctaaagggaaggtctctgaaggtggcaggtgacatccattagcagaaaagaactcaggatctagggaggagcatgcacagctggtaaaaggaatctgagggagatgccaacaatgttatctttaaaaacagagtaaaactagaactttgaacctaaaatgcattttgttcagtaaaaatggaggaagaatgatgctgtttctcagtagcgtttctatcatgtcattggagaatatggcaatatctacatggaatgtgaacagacggtgggaccttgtttggtctcgtaaccaactaggttctcatctttctgccctcccactcctccactccacgcacaccagtttcatccagttattcctaattgctctccagtggatctgggactgatggtcacagtctctgtgaagcttcacaagctgctttgctttggctgtgatccaccaaaagcagagaccacaccattcaaaccagcccttagctagttcttgtcctcatttcaagcactgcccctctctttttctctctctgtccaggaaatatggcactttggatattatcatgaatttaaagaatcatccattcctcatatctattattttagtaaagtgagtttattaaacccattctatcactaaatgatgccttctttttcatcagaaataaaattattctcctgtcctgaatgtaattttcattgacatctttgcaattaaggtgccaattaggtggcagcctcttactagaaatttgaatatagcaaggtgggagtgtttaactctgagtcaggaccacatccacaaagtcaacaatggtctgttttgcgtattagataaaacattacatagctagttgctaatgctattagcaaactccattccttaccaggcttaaaaaaatgttcaaatgtatagcatatctctgaaagtatgtacatttattctataatgatcgttcggtgactcaacaggataaaggctgtgagcattgtcctccaaaggaaaattactttcacctctttcctgtgcctttccctcctttgtcactgctaattcctttttttccattttaatctcctttgggtaagctcagccctccttaggaggagcgaggggtgggcaatcaaagccacaagctgtagcaaatgctaacagcctaaagcaattcgcaaaaccatggtggcctgagaaaagtgaattttaattccagggagcaactgacacatgataaaacaggagaggaaacatgaattcaccagagtattttgttatgctgtgaccttatcagtgggagatacacagtctgaagttgcaaaaaaaaaagaactttagctagaaacttctatttagaactcaaagccatccttttctaaactcatcctttgcccaccatatgcacaaatatgcacttgatttgggctcctttggaagacaatcctgaaataaggattcaagagtaagtaatatgttcaggatgtggtctaaggaaacagagataggagagtggggaaatgagccagggaagggaaggcaggcaaaaaggatatgtcattaagccagttgttattgtgggcaactagagctcaatctcactggccaattctagaaaaccgtgctgaatgtacctcagagttatccagttaagagatagggaatctggggtatttttacagcagctctttgttcaaaatttattgagggctgcttctagggcactaactctctggcacttccgacttgccctgttcacaggggctccatgctcccatgagtcaaaaaactcctcaggcagggagttctgggtattcccagtaaccaagattctgtgggtagaggtaagtgctgaaggcaaatgggcagggacactgagagtctgctacaacctccctcccaaactgctctcagacctccttcaaagacgcagtttgtcagaccactgttcagcccctgatttctgtttactttatattatgtgtgactttcctcattataatgtcaataatgtgagaaggtatggaggctcagtaattcagccacacccatgcttcattcctgtgatcaaatgattgtaagcctgaagcctcctccttgctgttttgtctgtttctccaattgtttcccatggattcactgtcttggcatgctctatttctatgaactaaatctaacaccttcccctcctccaatttaataaattgctcttttactcactgctacctaaatatgtattatgtgacatgttaccactctcagggtagctaagatacaatagatagcctttcttcttctacagatcattgaagagcagagatatgtgacttggtcatctatgcattctattcatacaaatgaattcaacacacagctctgttaacattattgacctagtactatatatgccagatggtaaatgtggaagttcttagacagtaatactgttccacccttttatgagcttccaatttagcaggaaggctgggataactaaacaaataatttaaatacaatatagtaatacgattttaaaaagatgttctgcgtgctatgggaaaaccaaagataggcatttatcctttcaaaggattcaggtaagcttcattgaggtgatccctaagcagcttttaagaaatgaggaggacttggccaggtaaagaaagataggaagagcattctacacagaggaaataaaaagtacaaaggaaaatagacataaagtagactgtgtgctgaaaagaaactgttcagagtttctagagtataaaaattgaagtatggtgtacaagagatgaggagatggagaggtaagttggaccaggatgtagatggctttggatgccttaatacctatcttcttatatgcaatataacatcctactcagaacaagaggttggcaattctgaactactaagtatggagtaagtatttgttccatttagttgctgaaagttaagttctgttaaacactccccttttttgtgtgtctatgggggaaggtagttggctttcttcttgcccccgacttctaattgacccaaggcttttcatggctgctggcctctctcctcaaaacggcttctggtcattatttagaaataagacatttgatcagaattttaatgggatgctaaaaaacaaaaatattatcacgttgagagtaccacctgttcttaagatctacttcttcatacccagctggagtcccttcctcatggtaactgtctcctccattttagagggagtcttcttaaagggaacaaatccattaaggaaacactaaacattttaaaaccctcaaacaaagcagcttttgttttattaagtcaaattataaagctatttctatagttaacattaggattcatttggcacaatttcattgagtgcccactaccttatactactcttgtcctctttccaaaaaggaaaaggaagatatgtgcgagtaagccatagaaggccagtggcttcaggggacattgcagctacagaagctgcttgaggaatttccatgtctttctcatctctctgcttccctaattctgctttgaagtgatcctatgatggctcacttgggcctaagtttaacacacaaacacccaatacctgaaatttacttcttttgggtgtattagcttctccaaagagtttagtttttaaatagactcatgtgtgtgtgtgtgtgtgtgtgtgtgtgtgtgtgtttgtgcgcataggcactgtggtgttaatatatatatatatataggttttcatccatagttcctgcctcccaacttccatagtccttgttatactgttgggtcactttaggcctcagaaaacataaactctctctctgaccttctgctgtccttctttcacccgccaaagcaggactctaacctgattatggttcaaaagaccctcattccggaaaccctgcctcataacctagaggaaggaatgctacacagagaaaccaagaaaagtctgaacagacaagccttgctaggtttagatcatgcactttctgtccaatcacatttttacatggttgtcaatcatgcctatgtaatgaagcctccataaaaatccaagaggacagagttcagagaacttctggatagccacacatgtggaggtgccaggagggtggtacacacagggagggcatggaaactctgcagtcctatccccatacctcaccctacgcatctctttaactgtatcttttgtaatagcctttataataaactggttgatgtgtttccctgagttctgtgagccactccagctaattaaacacaaagagggggtcatgggaaccccaaattgaagacagttggtcagaagttctaaaagcccggacttgtgactggtgtctgggggaggacagtcttggggactgagtcctcaccctgtgggatctgacactctctttgaatagatagtgtcagaatttaattagaggacacccatctggtgtctgctgcttggtgtgtggggaaaaaccccacacctttgttcaccagagacttccgtgatgatcgatgattgttgtagtactgtgagagcagaggaaaaacatacttagagtttttccccaaactggcatacacacagagatcaaaaaccttttctgtaaaggtacagataatatttttgactttgtggtccatatgatctctgtctcaactactcaactttgctctcagaacatggaagcagtatagacagtacatgaatgaatgggctgcctgaattccagtcaaattttatttatgggcactgaaatttgaatttcatataatgttcatgtgtcacaaaatattattcttcttttgatttttttcaaccatttaaaaatgtaaaaactactctaagcacacgggtatatagaaacatttggtgggcccaaatatgtccacaagccatagtttgctgacttctagtgcaacacattcactcactaagacaaagtgtccttcagtgtatcacagtctgaaccacaagaacagcttagctcttttcatgtcagtactgttgaattaaaaaaaaaaatagtggtagaagcagagggagcaatgcaggtggagagatgtctgagatcaatgaacttttatccacagcttagcacagtggttttcagccttggcttcatattggaatcacctggggagttttaaaacatcctggcacctagatgccacacccagagagtcccatgtgactagcctcagtatagtctggacatgggagttttaatggctccccaggagtttctaatgtgcatctgaggatgagggccactcatctcacataagactattaataaagacacagcacttggggatcaccaaagactagaagattgagctacattcatttttagttatctctttcccatttagcaggcttatctcactttctaactgcaaccttccttggccatctttcctgcatattcattgtagatccaaaataactataagaagttaggaaagctcataaacctcagagagaatattttgcattgtctctgtgttgtactgcacattagtctcattgtcccagtgagttttaggatctctcaggttcgtgctgccttaggagagcacacatttaaccatatgggaacaggctcaacactatcagccactctgggaaggttggatcctgggaaattatttcctggctacaactcctaggagacctttatgtaaagcagaaaggcaattacattgtaatctctaccccctatccttggatcctctgtctagaaatggatgtatctgggaagctgttatcaagattttggagcaacatggtgctgtgctgaacccctattaacctcaatagggaaactgccaggttcaagagactcagagccagcaaacgagacatacaattttattagcatcttacacacaggggacagagtccagcagtggtgggctgggcaggaaaaccataaccgcttgcaaataacaatgcagtttatatagcattttcacttaaaaccttccccctaaacgacctccacctggaaaccttcatttaacccaaaactcagggcctcaatccccggtatggcccatgttccatgagaagggccaggggctcagatgtttttcataggtaagaaacaaacctcagggctggccactcctggattccctagcttggaacaaacattcagatgcatctgccacacagggtcattgtaagagtatactgaaatgattgctgtcagatgtgtttcccctacccatggaattagagataacaaaacagaaggcttttaaagtatatttcataaggtaaagtaaattaaactttttcctaatctggaaaatgtgtctttcagcaacccagaatatccaaactcccagacagtgacatatccccacatttgggccttttacagtgagataaatgtatctctttcttgccggtttttacttaaccacattttagcttgaaggtttgttggcactgatttatcatacttcttatttaaatctgagtaacattatagctggattaaaaaatagctttttcttagttgacctttacacttcacaactttaattttgacttgacatagcttttatcattttccaatttaagtggcaaagattcgtgtattttatgtcatattttacataccttctaaatgagttggcacacaaatatttatgataatatgccttattagactaaaccttttttgagtttaatcaactggaaaaaattttttgagaagctcacagtaaatgtcagggacaaatgtgaaattctatgtcatttttgagataatgctgctggcaatgataatttgcagtagctgacttacaatcacaagaattttttccttattacaggataacttcttgaatgtcatcaccacaattaatcaacttctgccagagcttctacataagtagcacttttggtttcagcaaggctaatccatgatggggcgtttctcaaaaccacctggctctgggaggaccttccgcacacacacaagcagaaacacccacatgagtccctttggttcataacttcttgggtcatttctgcaagattgacccctgccctttctttttaaaggatattttacctgaaacagtagggagacatatttctgtgttaacattgttctaaagaacctatggtcacagtacagcatcaatgggaaagtctctatgcctctcctaagtagaacctctgagatgagcagaatacttggaagggtacaaatatggctaactgttgtcaaatgtagaaatgtcatgcttcaggtagaagggttcaggaaaatcaccaaagaaattagaattccaaagtgtatcaatttacttaatcacaaaattttactctcttgtcagaatcaacaggcacagtcttagagatcttctcagctgagttcatagcactgtaatttacttagactgctatttctacaaagaggaagccagagatcctttctgcagagactgtttagtaaaaaagaaaagccaccctttagtaaccactctttagtaacatagaaaattttcataattctcttaatcaagtcccaagaaactaattcctagctctttgctcctttgattaacttctgtttgatagttcattctataaatgcaaaacctgcctggctggaatgatttgttcttagtgaaatgatgagtaagcagtatgagaaactagaatggtcacaggctttgggtagactgacaatactgtttttatgctgattttatcacatgctaactctatgatagcatagtggtatgtcggtgtgtgtatgcatgtgtgtttgtgtacatgcatacatgtatggaataattaacctctccaatactcaatttcttcatttaaaaatattaaataatattctaaaacatattttacaaggatattgggggatggaaaatggctaacacctagaagatactaagtaaatgccactgctattcatgattattgaaggtggtggtagctggtaatgtggtccaaaagaaatttggttttggtgacttctctggtgcacagctttgaaaaaacttaggagttgtggttgacagttctatccaatggtcattgcctattcttctgcctgatttatcttctagtaatgatatgtgcacatttaaacattcttttaaaaaatattcctttattctatttaacctttcctcttattggctcaactgtaagtcctcatcactattaaccactgctggtatgctttaccaataagatgtgtactattatatgtgcatttgtaactcattaagacagtaactgagagagtaaaactcataagggcttctattttaccacttagcatattttgtgcccactgagggaaaagaataaaatgggaacaaacacttctcttaaactccgacttgtcaaaatttatgttgacttatgaagctcatttaataagaaaattgtgaacacctcaagggcaggaaccactttttcatttattgttattggattgaattgaatagttttagcacacatgaaagtgattcaagcacatttaccaaatgtcattatttttgtaccacatttattaaatgtgcaccatgaattagacactaaaacaacacagagaaatgaaatataacttctaatctttgattaaatatgtactgagtggcttctttgtactaaggcactacaaagctgctggagatacatgacaattatggcatggactctgttcccaaggagttcatagtttaatgaaacacccaagctcacatatgtggatccattagggagccaaacaagacattttgcagtcaaatactaaatacagtagtctggcaaagaccgtaagtcaataggaattgagtggaacagaggttgacaaggcttatgcttgacaggaaaggcctaatggggaaggctggacttcatttgcccttgaagactgagaaagatgtgtatagacagagagtggttaagagggcataacaagtggagacaaggtaagcaaaggcctcaggaggtggaagtcaagatggtgagctgagaaaatggtaaggaacccagactggctgagagaatgctggtaagcagaaggaaacaaaatcagaaagatggggtgaagtttaattactgtggggcaaatggggacaaacctagtgatcccctcagggcctttgaggaggaaggtaacatgatagtttctaagcagttccagtgtgactcttgtgaactcagtgcggttcatatgttcttatcagtttcctcatcagctttactctgcctgtgtatttggttgctgctctgcttccatgttaaagtcagaatatgctttctcatttaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagtaagtacacaaacctgatgaacaccgtattagttcattctcacactgctataaagaactgccagagattgggtaatttataaacaaaagagatttaattgactcacagttctgcatggctgcagagacctcaggaaacttacaatcatggcagaaggagtctgtcaaacacttataaaaccatcaaatctcgtgagaactcaccatcatgagaacagcacaggggaagcctcccccatgactcactaatcatccgccaccaggtccctccctcaacacgtggagattgtggggattacagtttgagatgagatttgggtagggacatagagccaaaccatatcagacacccagtctctgaaattcaacctcaccactgcagcatggctaggtttcaactctgtttgtatcagagcatgttctttatgctgctgaaaggtagaagcttcatcaggactgaacctcctgcatcttagctcctggcaggaaacccaaaatgaaaaagggaagagaaagaccaggttcaaaggtagcacttgtatgatggagttttaaattgctatatggcttaaataaatataaaacattttagaaggctctgattttgatcctctctgttacttcttagagaaaatattcataggttgagtgcacaaatttttccaaactgatttaaatctggaaaagtagaacttttatctagtttttaaagtagaaatttttattttcttttctatacatctgttaacataggggtcaacacataatgaaggcttaaattgcattttatatttatatgtgatcaattatattttctactggttttctcttttaaaagagaatatgaaaaaagtatttggggaaaaatattctcttttattaaatattctgttggaagttatatttggaatgaattagcatttgtgagatttttttatttagcaggaagctccatccacattgctggcatctatatttgataaatctttatatgagcagtgagttcatacaatacaaacaattatttgactcaaccaacatttaatgagaacctactatatgacaggctctagtcaagcaaagacttgaaggaagtgaaagaattagcaatgtagttttctggggcaaggtgttccaccacgcagagacagcactgatattcagcaggtacatgcagggaaggctgctctacttccttgtagctggcctccatcttgattggtcagtgcccttgctcagccagtttctaaaatatttttaatgcctctagaagaacagccagtgtggagcccctgaggtgggagcacaccgggtatgttcaaggaagaggaaggaggccaatgcagctgtggtgaatgaatgaggcaaagtgaactaggaaatgaatccaaagaggtcatagggctggatagagccttgaagagtgctgtgtgcagtcagcattcactctgattaagatgggggaaactggaggttttagagcagaagagtaacacaatctgccttatctttaagcaggatttgggggctgtgctgagaagcagctgtaggagaacaagagtgaaagccagaaaagcaatcagtaagccattgtcataccccatgtgagagattgggttttgaaacaaagagatagtggaggtggcgagtagtcaaattccgttaaagcattcagacagactgaaaaacagtaatagatttatttaaacatctatagtctaaattgtagttgtgaagataaaaggcatatttaaaacttcataaatatttatgctaaggtcagcaagccatttctgttcaatagctagaaaggtgcatggatagttgacgaatacactcacctcttggaatctaaaaaggaatgatattcaaaccacttagtgaccagtctggcagggatgttgagaaatcacaacagacactggcacaaggctggggcagtatgcgggggcccttctatgtcatgcactaaacctgaattatggggaaacctgggcttatagatgagagggagcacagggaagtgggaggtggactgggagtagtgctgtttattaactgacacagaagtatttttaaaaatttaacatctagtacagttgtcccagtgggtagcagctgacaatcagtccaatgaccaataagttaatcaagtttattctcacaacaaggtttatctttctacgtacaatttgagattattaggggggaaatcacccttttcatgtgctaataccctcaaaactaacagcccctacttgtgtatttctttgttaaacagcacctagatctctgcaacagaaattccctgcaatttagtagagtatatatacatatacataggcagtgcctatgctgatctcattcttgcaatctagctggtctaagctggtcttttctaagagaaaaaaagaaacaaagagaagtactttctattgaataaaaataagacagcacagtagtttatgaagtacatttgctctttcattaaaagggaagtatatagcattagatggcaagtatatagcattagatgatgagcaaggtaacaactcagtttctcccatttcttagcatctctttgtttcaatgttcttttctgctctagcatgaaagaaaatatattagtcagggatctccacagggatagaactgataacatatatataagggagtttattagggagaatttgctcacacgattataagacaacatcccacgataggctgtctgcaagctgcggaaagagagaagacagtaggatggctcaatccaagtctgaatgcctcaaaaccagggaggccgacaatgcagccctagtctgaagctgaaagcccaagagcccctgggaggctgctggtgcaagtcacagagtctaaaggctgaagaacccggagtctgatgtccaaaggcaggaggaggggaagccaagtgtctggtgcagcttgggaagagaaagagtgagcagactcagcaaacaagccgcttttccctgttctttcgtgtgctttgttctagccacactggcagctgattggatgttgcccactccacactgagagtaggtcttcctctctcagtccactgactccaatgtcagtctcctccagcaacacccttacagacgcacccagaataatactttatcagccatctaggcatccctcaacccaatcaagtatacacctaatattaaccatcacagaaaacttttagagcatgaaagtctctaacctgtcctctactatgatgcaacctattaattttaggcttgacaccctgaacctccagggtatgtattgcttgttaatgacagtgcaatattaattggcctattagtgctcaatactaatgatactcacagatcacctgtgggaaaacttgccattaacataattgcctccaaggaacttggtcttgcttcattaaaggactccatgtgtgaacaactttttgaagaggtgttgaaaattgacctaaactaatttatcagtttgacctctgtcacactcctgataaacttttcttgtttatggcaattagaggaagttaggagctatatacctccagctacaggtattatgtgttggagaataataagatactaaaaacagtctaaattgaagctgaatcaattagcatattaagcaagtgaaagccacatttcactgtaatgagttcatcagagtgtccctgaatgtctaagagatgggcaacaaggagggaattattcctctaggatttcaaaaggcactttttgattgtttacagaagggagaattgaaaaatctgttttagatttgatcattatcataccatgatgtaatttgaatggacacttaacctcagcccagttctggaaaggtccaaaatttgttatagttgttgttttaacactcaagaaagcttcggatgaggcagcagtcaagccctgccttggtctatggcagggcaaaggtcacagacaaagttgggtctatggtcatgggcgaagtcgggacagaattttctttaccatatgttacaataaatgcaagtcccagactgaattctaccacatgtacaagcatttattaacaagcagacaccacacaaaaaaaataactattcctgtgagcttgggaagttttctctctttatttttttatgaacattggtaagtaccatgcatgaaagtcattccaaaatagatgtaaccacccatattctgaccagccagccttctagatggaaaaggtacatgacatcctgttaaatgggggtggaagaggtaagggatggttgaagagagggtatgttgaaagagggaacaaaataggaccaaacagagttctaagcttgagtgctactctgagagtgtgaatcttgacagattattatacatccctcatgtaagattgagggtacctgtataatcttccttattaatcatatattagaacactcattgatttggggaatgagaaattgtccggataccttttgcactaattaacaaacctcttggaatggattttggatagcaattattgatggtaaattttgaagttacatggactcctggtgagggtccttcaaatgtcaattagctcctcctaaataataatacatataaaggtgtttatactgaagtatatttatgtagatgaattttatagtaaattacagtcagtataatttttttctcatttttactttgtgggaaggagtatggttttgaaaattccatggatttggctgctattgaaggtacctctcaggagctcacaaagagtcaccgcagaaacacttctggcacaccttccatagcagtgtctggaacctctctctcctcaggtgggtatttacaatgtgcctactttgttgtttaaaatgactaaatcaaatggaattgactgctatgtgtggtattaagtggatgtttcatcctttaaaaaataagcattcccttctttgacctatggtggtaggccactccataagaactgcttgaagatagacccaggtaaagctttgggcaccttacattcatgaaaattccatttatttagtacatactcttgccaggtatcatcactgagtttcagtgctacatcagaatatcaatatttgaatgaaggaaatataaattattccaggatacatttgctataacagataagaatgcttgctcagagttcaaggaaatggtagttcaattgatatagtagtcagaagttccctacatatagacaaaagaaaatcattctgtggtttaaataagaagttatttgcaagcagcactaaagtattaataattacccctttcatttgcatggtacactcaaatatgtcattttacttcattatcacaacagtcctctgaagcagctattattcattttgaaatgttaatagctatgactaagaaaattcttcggagaaatttgtcataattttgaagcttatgtcccatacatggaataaaaatcatgatgcagtcttcaacattaaaaagctacctgtaacctaatgattatatatgcataaagcctaaggcaggattctgtttgctgaactgaggggtctcttctagccagccagctcccaaaggattttctaaatgtgtgtggttattgctacattttgctcaggagtaaaaaagctgttcacctgttaattaaatttttaaactagtttagaaaccaacatcatagggtctactactactacttctactcaacagctcctgttaattgagtacgtactctgtgtcaggcctatgctaagtacttctgcattatttttttcatcaattcaaacttaagtacttgattactctctccaatctttctcatttataagtaactatattgatctcagtagtgctttggtatagaactattttgtggaaataagctgtcctgacttggtaagctgtccaaagcattactaagaggtgcattgctctgtaacttatattttcaaaaagtgaaaacaaggtgttcttctgatgaaagactcttctggtccattaagaaatagaacttcctctcattgcatctatagcctctcatttttgtgtgaaaagaacttgctatatcacttcaaagtggcagtttagaataggttgcattgcattttatgtcaaatctgaaaacacagtgaattctctaaatattgcaagcaagaattgttaatgtttttttttctaaatttaagggcccattctaagagagttttttaaagtctaggagcaaagcagttgccttaaacagcttaaaacatagcattttacagtagaacatttaacctcctgtgatagaaggaaacatgaacacctaagtgtaattcggtccaaggcaattaccaaaatattattaaaaatagaagtatgttatcataaacagcatgaagttactgactccgactgttgctttcatggcactatttatgatctgtgcctaaaaagaattgaaataaaggtgaaacacttggaataaaaaatgaaatcttctcacaaaacaggctgactcacgtctttctttttcctttccaccttccagatcagagtcgatctgagttagatttgagtgagtcatttacagaagactcagaggatactgtaagcataagaagcaagtctgtccctggggctttagacaaggtaagttggatgtggaagaaaatataatgaagaggaggaaataagggcataatcttgctccaagtggtttcacttttaggtgatgatgagttgagagtaaagagaggatatacaatcatctcttcctgttagtcttcacagtcaacacataaaaaccgaaagaataacttagaaaatataatgggtaatcatgttaatgagtgaaggttatgtctaagaaaacacatgttggagatttcaatttctggctaaagtcttatcacttaatctaaacctgggaaatgagagatcctaacattttccttagccaaatattattagaaatatctgattacatatttatatcaacattgctatatctcaagttaccaccaataaattcacttctaaactgagacaaaattatgtgaaaattaatgtttcagtgaactcatttctagaatgagaaggttaaattagattattgtaaaggttatttcccagtctaatattctgatattcagatttctgtaattgctataataaaatacggactccttggaagaaatagaacacaaatgtaaaatggtattgatagtttttccaaagcacactaggaaacttagagttctaaaatgaaataatattttctatagtacaaaaaactgggaaaatactttaaaatctacctccaaaagagagatgggcagtgagattaaattatttcaaagtttactcatgttcaacctttaaagaattactaattccaacattattaaactattaaactattcgtgatcttagaaaaccattgaaatcttttcattcattgtatgcagccagtataatcttgacactcagacttgatttttaaaatagtttgaaaaataaaactacaagtcaaactagtttacgaatatacatgcaaaactttaaatataatatcaattaaaatctagcagtgaataaaaatagcaataagtaagttttatgctaagtatgggtggaagaatgagtctatataagaatatttgtcagcataatttatatcaatatactaaagaagaaaatgacatgattctgtatgtagaagatactaaaggatctacaaaaatatgactagaactgataaacaagttcagcaaggttgcaggagataagatcaatatacaaaaatcaactgtatttatatatactagcaatgatcaattggaaaatgaaattaagaatataattccattcataatagcatgaaaaatatttttcaaaagtaaggaataaattcatttttaaaagtgtaatacatgtgcattgaaattaacaaaaatatttctgaattaaaggagacataaataagtagaaacatattctgtgttaatggattagaagattcaatatttttaagatggaaattctctccaaataaatttgtagacaatgcaagcccaatcaaaatacaagcaggataattttgtagaaatagaaattattattctaccatttatatgaaaatatatgggacccagaataacaaaatcaattttaaagagcaaagttggaagacttatactactagatttaaaaacttactctacagttatagctatcagtacaacacagtattggcataagcattggcaatcagtggaatagaattgagattccagaaaaaaaaaaaaaactttatggccaattgatttttggtacttcagtggggaaagaataaccttttcaacaaatcatactgggacaacaggatatccaaataccacaaaacataaaagaactttgactcttaacatataccatgcagaaattaagcaacgcaaaatggattataaacctaaatgtaagaacagaaaccataaaattctaaaagaaaacctaggagaaaatctccatgactttcagttaggcaaagaattcttaaatatggcactgaaagcatgatgcatgtattcaagaaaaaaaactggtaaattaaatttcatcaaaatgaaaaatgtttacacttcaaaagacaccactacagatgtgaaaagtcaagccacagactggaaaagtattttcaaattatatatttgttaaaggacttgtatctagaatatatttcttaaaacccttacattcaatattaaaaagacaaataatcatattagataatgggaaaaagatttggatagacatttaatcaagaagatttacaaatgcctaatagctgcattaaaatatgttcagcaacattagttatcagagaaatgaaaattaaaatcacaatgagataccacttcacacccccttgaatgggtgtgattaaaaagacataataataagtgttgatgaggatgcggagaaattggaacccccctacattgctagtggtaatgaaaaatgctacctacagccattccgtaaaagagtttggcaatttctttaaaagttaaacataaatttactatatgacatagcaattttgatcctaggtatctacccaagagaaatgaaaacatatgtccacataaagacttacacgcgaatggttataatagccaaaaagtgaaaataataatatctggtgaatagatggaatacaatgatatattattcagaaataaaaagaaatgaagtactgacacatactacaacatgcatgaaccttgaaaatattatgctaaatgaaagaaaccaggcaaaactacatatcatataattacatttatatgaaatgtcaatgaaaggaaaattgatagagaaattaaagcagattaatggttgccagggagtgaagaagtagggactgactgcaaacaggcatgggggagcttattgggttgaaaatgtactaaaactggattatattgaagtttgctcaactataaatttgctaaaaatcacggaattacatgcatacaataggtaaattttatggtatgtaagtcatacctctataaagttgtgggagaaaaaattagcagcaaggaaaatagctggaaaagtgataattgttaaaactaggtaatcagttataagggttcattatgctatgctttctattttgtgaatgtttgaattttttaatatccacttttgaaaagaaagtaaagaaacatgaagactggtactttatgtgatgactactgggtaattgtataccaagaaagagcaaaacataaaaatatagaaaaggggcaatttgaaaaaataatagggataatagggatgcattttttcagaattaaagagcttattagtttcggcagctttttgctgaagtttttagagtgttctatatataaaatcatgtcatctgcaaacagacaattttacttcttcctttccaatttagatgccttttatttcttttacctgtttaattgctctggctaggacatccagcactatatggagtagaattggtaagagtgggcatactgtattgtttctgatcttagaggaaatggttttagcttttcaatgttgggtataatgttagctaagagcttctcatgtatggttttatgttgaggtaaattttttctttatctcatttgttgagtttttagtatgaaaagatgttgattttgtcaagtgccttttctgcatctattgagatgatcatatgggttttatccttcattctgctaatgcagtttatcacaactattgatttgtttatgttaaaccatccttgcattccaaggataaatcccacttaggttgaatgagcttcttcatgtgctgttgaattcagtttgctagcattttgatgaggacttttgcatctatggtttatcatggatattggcctgcaattttccctttttttggtagtatccttgtctgactttgctatcagagtaatgctggcttcataaaattagtttggaagtgttccctcctcttcaatttttggaagaatttgacaggaattggcattaattcttcctcagatgttcagaagaattcatccatgaagccagcactttcttacaagatgctattctacaagatattccagctcatcttgtgggctcatcagtgagaaaaaggcagctacaataagttctcatttaacatcatcaacagattcttggaaactgccactttcagcaaaatgacatataacaaaaccatttttttcctcatcaatgttttaatgaaatgacattatttgaggacctgctgcacatcctttcacttaaaattacagttttcaagaacctatggatgacgttaagtgacaacttaccataaaccaatataaaaataagcaaattttgaacaagtatttcacaaaacaggaaatccagttggctgattatcacaaaatggtattcaacttagtaataagagaaatgaaaattaaaatcatgaagactgtaaacatctactggattggcaaaaatgaaaaaaatatctaacaataccatctgtttgcaggcaaggaagtggagcaaagggaactctcatatactactggttagactgtaaattggtgtaactacttctgaaaatttgacattatctttaaaatgatatagataagcacgtggagatatgttcaccccttgacttgacaattcctctcactggtatatattcaagtgtgtgaacatatatactgtgttgtgtgtatactgtggtgtgtgtatatgcgccaggatacatattcacagaatatacatatcagtgttggtcacaatagaaaaaaatctgaaaataacccaaatattcagcaacaagagaatggataaagttttggatatcatacaatggaatattaaatgacaatataaatgaacaggctacaaaaatatgccacaattttgatgaattttaaggcaatattaagcaaaaaaagcaaaactcaaaggaatatatagcatttaattacatttacacaaagtacaaaaacaggcaaaacgaaatcattttgtttcagagtatacgcttatgcagttaaactataaataaaagcaagaatgtggttaaccataagagttaaaatattaattattcccgaggggagaaggggcttgtgatatggacaggatacacagggagcttctgcttcatcatttgattttgttattatactatatatctatgttttatgtactttttaatatgctgtatcttataataaagacttttttaaagcaagcccagaagtgtacatcataatcctgatttataaaactatagttaaaaaaattcccatgaatgtatacttatactcagatttgtgtatgtttttatatgatttttcacataaacaaggagaaagacatggaatgtaacatgtgcagcaggatgctaaatattaatttcacctggtgtgaaaggaggggaaggaggagaggagaagcaaaaaagaaaagtgcccataataaaaagcagtatgcatgatacaatctatctatgtgtatatatgtatgtgtgtgtgtgtatatatgtatgtgtgtgtgtatatatatatgtgatgatataatcaaaaatattgaaatttgatcattaatatgttaatgagagacctaagtttttagtttccatttatctatattgcttgaaataattttactaggaaaatacatcacttaaataactaggcaaaaaaaaaaaaagccattttatcatgaaggagaaaaagaaatgggaaaggaaaagtagaatctgggattggagatgagagtccagtatctagttcatcctagtggagagatttttgagatatgctttaccatcttggcagtgtgtgtgtgtgtgtttgcacacacacacaaattttttttaattttaaagtaacgtaagtacattgcccaacatgaatcaccttagaggtaggaattgaacccaggtctgtatgattccaaatttcatgttctttcaataaagtaagcaccattagaaaggagacctcactctccaccccctatccctgcccacttctccgatggtataattcagattgaccggagaggaaaagagaaaaacctaggaatggagtgatttctagaaattttttatctgattctcaaatatttatgaaagaaagtggtttctcaagtgaaaaaacattctagaaaaacaaatcaaccaacccactgatttttccctttcttttttaggactccttggaagagactgaagaaagcattgatgccttagtgtcctcgcagttatctacaaacactcaccgtctggcaagtggcctatcaactgtaagcagttcactaggacatgtggaaagtttcttttccctctttttgattttctgtgcatttccaaaggagatatgaatgttcttaggaaaatgtgtgataatgagttaaaagtcattgtaagatcctgcttgccctttgcccacagagtacatttcagtctaatttggtgtgggttttttctcaggctcctgatttcttccttcttccacagtcctcacccaggttttaaaatctcctcactccctagttcaggctcagtcagctcaagcctataaattatttttcaattatctgctgacacatttccctgacaccattctctaaacttcccagctgtcctccagactgctgccagtcatttatcctaaaacacatgcccaatcaggtctgtcttctactcaaaacccatccatagcttcccactgcctacaaaataaagtcctttcttactttagtgttcaaggccttttttgagaggaaggccctgtgtccttgtatctaactgtgtgtaagtctttttcttggcttctctgatttctgttgctctgatgctttttttcttttgatctttggatgacttctctaaagagttctcaagcaggttctgacaggaagtggacctacctaaatgtgcctgatgctgactcagacactgtgagttttcaacctttcctttttgttctttccaaccatacttcacaaatttcatggtctgggaactatgattaagcaatttgtcccacatttatctttttccgacttatatacaattaaccagaggttatcttctaaaagattgatgagatgatcagaaaccaagtattccaattcattaaacattggaatctgaacaccactcaaaagacacatgctctaaaatgattaactatcaacaaaacctttgaagtaaacaactattttaaatcacagccttagcttggttaagagcatatagtttagttagtagtaaaattgccataggtgtcttagtttctcacaagcctccgtatttgtgggttcctaaatttccttctatccgtaggggccctctgcttacagaggattttctttgaaaatgtggctacagagatctagtatagacacaaatcagtgatataaggaggtaatcaggtatggtggggtagtcctcagactagaaacttggagatcttgctttatttcttggccataccaacaatttttgtgagccagaattttctcatttgtaacatgagtaggttggggtttattcttgaaacctttgatactcaaagcattctctatggaccagcaacattgcatctctcggaacagataccccaaaactttctcagttcaaaaagcccctaatgtctcagtaattctttcctggcactcctacactaaaagtagcacctgactagtccattcattaagtagttagaaccaaataatgtaataagcagtgtatcctaacaacttactagccatttgtaaaaaaatgctacaagtgaaagaaattgaaagaaaaatagtatttttatttcatccttaaatagcacctattacttaccactaataggatatgtgtgcctattgagcactacacagttaccaaatcttggaatctgattggacatcactactttcatttcccatttcacattgatttttatgcaatacttgctttttgttgcagcaactgccaaaaactcagcttcagacaaataggagttcattgaaaagaataaagtgtggtttaaagttgacactgtgaattactagttagtggcttacatggtgtctgataggtgttgttgtgtttcccttgagaatttaaaatatttctgtgattcccctgtgagtttgctgtggtgctctgtggtacctcgatacacagtttcggaactgcaggcctaggagtttgttagaacagccaaatctcagacctcaccccagactgaggagataagcgttttcagtttaaaaaggtatctgggtgctgctcaaagccacctgctaaacatgaaaattctgttgctttgttttaggaataagaaagacagattaggtcactcactggctttctttaagctgtaatttccaaataattatggaattattggtctgctcttgcccgtgaagaagcttagaagacatgtgaccacatcacccacatcctgttctttggtcagtctctacttccagaaattggtggaacataatggcttttaccaaaagcaaattatgaaaaagaagacagtctaaggtccctgtgtatttaccatagtcttgacttcccagtggttcacagaaaagtggttttgaaactattgggtcatccacgaaagacctccaggtggtcttttgtgacagttactgagatacatagttttcatttctagtgccaaaggataattttattacatttacagtagtcacctttatccacagaggatacattccacctaccccagtggatgcctaaaacctcgcgtagtaccaaaccctagccaagaaacaccaaggtcacattttcacttaaagaaagcacttttggcttctctttgacatatgtaaattactaccatcattactcttacactgtggagtcattattaagtaaaataagaatgagttgaacacaagctctgtgatagcaggacagtcaatctgataactgagacagctaagtgactaatgggcaagtagcatctgcagtgtggctcctacagtgtgtccaactggacaaagggaggcttcacatccagggtgggatggagcagtatgatgtgagagttcatcatgctacttgtgaaccccaaaactctgaggcatgtctcagttaatttagaaagtttattttgccacggttgaggaccggcacccctgacacagcctcaggaagtcctgccaacgtgtgcccaaggtgctcagagcgcagttttgttttatacattttagggagacataagacatcaatcaacatatgtaagatgaacactggttgggtctggaaaggcgtgacaacacgaagtggggagggagcttccaggtcataggtagataagagacaaatggttgcattcttttgagtttctgagtagcctctccaaaggaggcagttagatatgcacttatctcagtgagcagggggatgactttgagtagtatgggaggcaggtttgctctaagaagttcccagcttgactttttcctttagctttctgattttgggtgcccaagatattttcctttcacatactcaaaacagcatacaatttaaaacttatgaattttttgtttctggagttttccatttaatatttttgaaccgcagttgaccatgggtagctgaaactacagaaagtgaaactgtggataagggggactactataaattaaaagctgtctcatgtcattagtgtcttgtcaaaagcctcattcattctggtagatttggacttttttaaaatttattttcctgattggttggtgtgtgattttattgtgtagtagtttattttgtgggctgctactttatacagatttacaaagccatggtcatatactactcatgtagccacacagctagctactcagttgagggaaatcatggaagctgtgggtatgtgatgttcttctgatatgtccttgttaaagctgtagttatggctccccggagactgatgggatgctccatgtaggtgtcaaagaaagcagtatgtggctcctgctagcacagaatatgagataagctaccctttgtcccaatcaatgtattctacaccttatagtagattgaacttgagtctaacagtgaaaatggagaaagctgcagagatagacgagaagtgagatttgaaatgcctcaattaccctgtattcattagtagaagtgagtaagcaaagggtattctctaacccaagaaggaaatgcttcccctctaagcaaattttctgccttttttcctgatggtactagatctgctgtcttttctccagctgggattttatacaacaccagccaaacaagtgactcttgttttctttcctcaccctagacttccatgctcattataaagaacaggaactataattgaatgaaatgagttgattctgtgaagagatcattagaatgacactagaagcctttttccatcttgtttattccagaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcgtaagcacatagcatgttcctcagactatttcagtcactgccttttttgtctgtatgtgtgtttccttttcaaaagagtcttagcattcttcttgattcagtcttctcagagagttgattgtcatgttcctcctataccacacttttaaatattctctgaagcaaatgtatactggttgtgtctttgattaactgatttttaaaacataattcaggattgacatatttgcaatttacacagaggcagctctttgaagtagaatgctgacatgttggcacacccaggatgtacaaaagcatcttgtcgatttctgttctgggaaatcctccagagaaaattaccaaactgttacccaattaaacaactcaaaagggcaattatgaggctctcaggattctagagatcagcctgggagggcaggtatggaccatagcacactggagagaagctagatataaaggtgtgtcaggggttctcaagaccactgccaggttcagtgattcactaggaggacttaggactctgcacgcagttataatcagcaaagaggcacatggggcaaagtccaggagagatcaggctcaagctttgcaagggtcctttcccagtggagtcacataggatgcatttaattcctctggcgatgagttctgacaacatctgtgaaatgttgtctgccaaggaagcgtgttagaaactcagctggtcacataccaaatttccagtctctcaggagaaaaagaacccgttcagcataagccatattgtttgtacaaacaatttaggaacaacgagccacttttatcagttctgggaatggtgggaatcctgaaatccaagttgccagatgccacccaagggccaaatttgtaagcaggcatttagaagaatggtagtctcaggcccactatgttaactcttttctgcacaatagatgacctaagtccaataaataactcagtgaacctggttccaaatcccctaagatagacaaatgagtggattttgactacagattggtccacctgcctcctcagctacatttcagagggctacaggaccaatgtaattattttgactggcatggaaaggggtcttctaaaactcaacagatattctgtagaactttggtagcatcttatacatttcagctttgtacacatcttgtacatttctgagtctgctgtgataccctgcttcaagaggctcctgagatagctcaagctaaagtgttgggtagaattgctatcactacttcaggttgttattttttattttgcctttttcactgttttcttttactcacccattaccattgaccccactctctgacatcagaaggcaagactagtaatagagaagcatctaatcccagaaaaatttgtgagaccattaatattaatagtgtattacatgtattgagtagtacaatatggtagctccttggatgtgtcaactaatttaatcctcacaaggccatcagttagacagtgttattttcccagttttacagatgaagaaactgaggcacagagtggttatttagtaaattcttgaggtcaccaaatctctgaggcatggagtgattcaaaaccaggtggcttgacttcagaacccacactcttttatcattatactttaccacttctctcttacggaaggcccagtgttctattttaaggtatcctgttatatagacaaaattctctttggtatttccgctcatgctcactggccctttgccccttttattcacagcgaagtctttgaacatttcttgcaaatagatgtttcacaataattacatttatattttcttatctatagttatgtcaagtcatatcttcttcctgacaagtcccggaacaacaagcgtaagaccaaaatcagaacaggcaccaatccagaattcaatgaaacactaaaggtaaataaatacggtctcatagtaactcatgtggtactgttcacaacttcaatggtttagaagtaactacagagaatattttatttgtgtgtcaaggcttgtatatgttttagaaaattagaatttgaataaattaacataataaccttgacttttctaacatcttttgagaaaaagaaaacactcttactctatttaagtctacgctgctactgaatttgaaccttgagtagagaggatccagccaaactgcatcggtgctgatgcttcttgctaaaaaatcggttttacctttgggcaaacagtgctttttctgacttccgtaaaagaagcttgtcacagttttgacactacttaatgagtcactttgcacgcattcattgttctgctaacatagcataggtctatactgtttgttgttaggatttcagaatttgaccaaatgtaggtatgtggttaatgaatagtggaaatgcagagccagatttgagaaatctcagcaaaagtagcctagataaaatatggcccaatccaggtcaatgatccagaaaatagaaatctctttccaatgcgctttcacataattaaccccttctcttgctatggaacaatctggcctggtaagaaacacccagggaggatggaaagcagaagttattgccaattctatggaaatttatgggcttgtgccccagagtgatggtgtcagagtccactttaggaggaaattggtaaaggcagaaagccacaagcctgcatgtgtcagtgggagcgtgtgtggaagcaggaactaatattaagacagaacaaactgaaaaatgaataaatacaggtagagagtaaattcaatggccataacaggataggaaagatgagcccaaacacagtgagagggtaaatttaggaagcagggagccaaggttaattatgacagtaacagcaaagacaagaataggcactaatccaagatcaggaatcagtcagtgtgaagtgtgtcccagatggtggttgcatagaacaagcagaaggctggagggtgtgtgagcatgtggccctggatgatgttgttacaaaaaacaaaaaaaatgctagcccagcaatatcttctttctgtttaatatacatgtacaccttttcacctctgcacttaggctggactttataaaatttggtgtttgcgagtttctcattgtcaatccttttctggatttggggattctcattatgaataaaataagagagaaggtggagaatgtatatattaaaccttgagcttacaaagtaggtatgaaaaaataattaaggaaaatgaaaaaccaataaaactggaaagaggataagcttcatcacctaacactttttatgcagtatatggagtttatctctacctcagataatttgtttatatatctttcaatgcaaagtctggcacaaaatgagtttatggcatagaacttcaattgtagcagaaacaaagaaaaacaaagagttttctttgtgtttgttttgttcatattactgatgcatatgatctgaaagatgttggaagtaaatttcgacctctcctggaattggatagagccctccttgtggagtgtaatgttgtaaatctcattcgcagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtaggaaatgctctcagattagtcagttatgcaatgagacaagttatgagcgaaattgatgtcacagacctaaagaacttgaagactttcaaatttcaagtgataatctgcaaaaaattagtgcagcaaattttggaataatattataaaaatgttgtaaatccaccgttttggaaattctttgtcaatatagatcatctgtataatgaaagctacataatcatttttttgttaaaaatttttattatttgacagtctcattggataactgaaagcaacacattatatgatcttattagagagtcttcattttcacataggcgaaaccaaattcatacagcatgaacaatccccaaacattacctttatttctcattctccacaatttataccacaaacaggagtgatcttgcctttgcttatatgagggaataaccagtagctaaagtatctgattttcttactttcctacttttgggattcatgacccaggccttgagttacattcagaaaaaaaatcttagagctgataattaaatgccaatactgtatagcatgttctaatctagaccaacagtaccttggattcactttaagtgactggagtctctatgcatttacagtactttttaagccaaaatggaggtgagtaaaggtcacatttatgcagccaaagattattgtttatatacagaaaggcaaaagcacattatgatgaagacagtggactcaaatcaaacttacttggttctatcctggcttcatgactgcccatgtgaccttgggcaaattatttaactttttattccttagtgtcctcagttataatataatcgtgggatgtagcttataggtctgcggtgaagcttgaataaacattctacgcatggccgtcagcattttattgggaacattgtaagctctcaataagtgctagatagtatacgtgttacttgggagtccttgtactgcaacagacagaaactccagctaatactgctcaaaaaatagagggagattattggccagcagtgattaggcatagcttgatccagatgttcaaatcttatcaaagtcttggaatttcttggtctctcttcttatcttcattggcttcattttcaggttccatgcagtgttgccctccctgactagctccaagcatgcctctctaatgactacagtggctgcaagcctttcatctttgcaccacactgttcagaagaggagagttcctcctcctccaacagccaaatcagtgcattgggcctggttctcctaattataattctgtcatttgcctattctaagctattgactgtggccagggaggtgagatgcattagctggcttaagacaatcagaatataccctggttctgaagaagggaacaatagcatccttccagtaaatttcctggaaatagttgaaggactttgctggaatgatatctaagctcccctagacctctcctaggcatcctttgtgcttagaaatcaacattttccacagtaatcacttccacattgtcaatgagtggttcacagtctatcataagagggaagcatctctaagtctttctgagtctactgaaggtagaaaagttctgattgcattcactgtggaataccatgggtcctctgccagatacccttaggttcctaaccatgtcttttaggagatttgccacaacagcctccacctgagactctctttagaagacttccctcgggctactgtagctttttgcctatgtaagcagagagccagaagtcctgggaatttttatacccgctgccacaagacaacccttcatcaataactgataggtgggggagtatgaaggcccacttccttactgaaggtgggaaaaactccaaagtgttacatatactaccacatcaggtggaagctatcttccatggaattatgcccaagattagacttgtccctatagacttgcttcccatacctctttactggtctctctgagagaacttccttaataaatcacttcataagaatcttcaccttagagtctatttctgaagaacccaacagaagttagtgtctctaatctctgccatcttcctctgcccagcttcctctgttctatatagaagaaaagctgaagacacaaacgtgcttagatatcatgtcttccataaatggggaggacaggcataaaggcatgctctatcatgctctatatgctgccttgtgcttcattagtggctcatccccaggctgagctgggctctgtgtggttgattatcagccagctatgtgaagtggcacttcagtttcagtttcctgcctcggtcatttccatgcaattgtcactccagcagctgcagatgtagtatgagcagccttggagacttgacgtttctcatagattatgcagtcgagaaggtgaaacatgagttacacatactgatttccctagtaataggggatcagaattaataatccttaataatttagaaatactgacatacttctgcactaggagttccagaacggcatggtgccttattgcttattgactctattagtgaaggttcctcaatatttatctttgtatgggttagatcctacagtgctaagccagtgaggaggctggtgcagagaaagaactcaagatgccaaacatactgtagtttcacagtataacttccattttacttcatggcatgggattatttattagctgtaaagccttctgaaaggcatgtcaggtagttagacaaggttttatcagtatgaattgcctttcatgccttcccagagtgtactattataaaaacaaggacatctgaaaatcaacagcaagcttacgtggttttccaaggaaacgttctcttattctgccttcaggtagagagtaaatgtatgttcctttggaattatacctagattaaaggctctctctttttttggcagacttttgtctgtaattccttactctgtgttacacctgtaaatgcactgggagtctctttctcactccgatggaaagtggacctctctttttttcagaaagcaggaggtggtgggtgtcatctgcttatttcacatccatgctcagatagtctcagtggttccctactacttttggatatggtttgaataaatactaaccctcaccctggcactcagtgttctgttgaatggcccagcctactgtagcagccaaagatgttagttctctacccatccccgttttcttgcaaacagggctccccacttctttcactcccaccagccaacccctgccaatcattgtaggaggggagccttcgggctgctagagagggcttggtttgcaggccagaaaagccaacatagcctgggtatttaagtctcctgggggtgagcagagccttgatcaatgactggtggattaaggaacgtcaatactcccacgttcttgcctctgattggaacagctctgaagtgtgatctgtcacatctccagagtacccctatgggacttaacaacagttactctccatggaactttgcctgaaatcacatccttaagcctccttcacttttggtcccccttccccagtacccttcctaataaaatactataacttaaataagtgccttagcatcttctgggaaaccctgagttgacaccttattttcatcctccttgctactacctccctgtacacactcccctgatcacatttgacttcctgtcagtccctaaacatattctacacaacccccatcatattttactcatactgctttctcaacctggactaaccttcccaatccatcttcatctgtcatcatgtctcccatcctttaaggaccaggtaagagccacctctttatcccaatctggattaatctttctcttcccatagtagtttctttttacttgtgttggaataactgtcaccatttatcttacattgaactttctgtatagtagaaaccctcttgccccagaaattacaaccagtagtaggtcagttaatagacaaagtcacagaaatcacccacatacaaacacacacaatatatttcttttatttttaattattttgaattgacacataaaaattgtatatatttatcatgtaaaatatggtttctaaatatgtatatattatggaatggctacatcaatctagttaacatatatattacttcacataacatacttttttgtggtcagaacacataaaatttactctcagcaattttcaagaatacaaaacattgttattattaataactatggtcaccatgttataaaatagattcctcaaatttattcctcttatctagctgacattttattttgttaggccagcatctacccagttctccccacccccagcccctgataaccaccactctactctctgcttctattaattcaactattttagattccactattttagatttatatctattttagatataagtgaggtcatgcagtgttcatctttctgtgcctggcttattttaattaacataatatcctccagatttatccatgttgttgcaaatgcaaatgacaagattttattttttaaggctgaatagtattccattgtgtatatataccatattttctttatcacttcatccattgatggacaattaggttgtttctatatgttggctattgtgaatcacgctgcaatgagcatgggagtgtagagatctctttaagatacttatttcaggccgggcgcggtggctcacgcctgtaatcccagcactttgggaggccgaggcgggcggatcacgaggtcaggagatcgagaccatcctgggtaacacagtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagatacttatttcaattcctttggctatatatcttgtagtgggattgctaggtcataaatatggtagttctataacacttactatatttagtctttttgatattagccattctaacaggtatgaggtaatagctcattgcaattttaatttgcatttccctggtgattagcgatgttgagcattttgtcacacacttttggccatttgtatgtcttcttttgagagatgtctgttaagatcctttccccattatttaattggattatttgttttcttactattgaattgcttgagttcctcatgtatcttcgatattaaatgatttaacttaaactatatcagatgtatgatttgcaactattttctctcattctgcagattgtctcttcactctgtcgattgttttctttgctctgcagaagttcagtttgaggcagtcctatttgcctatttttgcttttgtttcctgtgcttttagggtcatattcaaaaaaaaatttcccagacctatgttgtggagcttttcccctatgtttttcctagtcgttttacagtttcaggtctcatgcttaagtctttaatccactttgagttgatttttgtatatggtgtgagacaagggtccaatttcattcttctgcatgtggatattcagttgtcccaatactgtttattaaagagactgtcctttccccattgtgtatttttggcacttttgttgaaaatcaattgaccataaatttatttctggactctctattatgttccattggtgttatgtatctgttcttatgccagtaccatgctgttttgattactatagtttcccaatgcatttcttaaacatttatttttaacttaaaccaaataaatgtacgttcatttgcaagtcttctgatatagaggcaattaattttgtttgaatttcgttcagtaagtaaaattctgccatatattccttgcataaattctcctcctaatgcatcatcatcagaagattctaatttgagcttttctcaaatgaaacaagaacataagaatactttcaaagtaaacaaaatgcaaattcttctaaaaaatgtatgattttttctaacctttgatagattcaagcccacatataatccaatagcaactttgttttcaaatctttagttcttctattcaactgaattgttatagtagcagctgtctttttgcactcatcaatttatgtgactttaaactatataattaaaatcacaaatatgcctggcctaaagagcttaggggactaactaatgcagctgactctcagtgtgcatacaattgaactgatgggagcagatgcatgttctttgcagaaaggattctgctattcacgagggatgaagaacactaattaaactgatgagtcagcagttaactaagtgtgaattaatagatcctgctactgcaaatatgtctactagatagactgaaaactcattgaaagcagggtctgtcttttgtgtccccacagcacttagcaaaatgccttataaaaatgtaagcattccatatgtgttggtagagttgaattgaatatgattggattctgctaactttttctgagtaatagtgggttggataatgacaatggtggtatgccaggagagggtgttgcctaggaatttcctggcaaaatataagtatcaaaaataccctaagacattagacatgtgcaggctgcaatatgactcccctgctttaattttttatatgtgattataatgctacaagcttcatcattattgtgttttcctttcataagacttgaagtctatatttatacggggtctacagtatattttaagctaaaaaccaatggaacattggtaagtcccaataatgcatgtttttgatctctggtagcacactatatattagtatgtgattcctacacatataactttttcctactggcgtattttcatacccgaagatctcactcaaaaagcaaacacagcctgctctggttaactattgctgtatgccaaactaccttaaaccttcggggcttacagcaagaatttattctctctcatgattctgtgggtcgactagactcatctaggtagttctcacttagggtttctggcgccactgcagccagatggttgactgaggctgatgtcatctgaaagctcaactgcattgattgttcgagttggctcacttccatgtcttacacatgatgttgactgctggctagaaactcagctaggcctgccagctggagcacctacatgcggcttctctctgtggctttagcctctcttagtacgagttcccagaggaagcattcggaaatatccattccaagaaagaaaagtagaagctgtcaatcttaagacctggaccccaaaactggcacattgtcacttctgccatattctataatactagtcaaagcaatcacagagcccacacagacccaaagagaggtcacaaataccccatctctcattgatgacggtaccaaaaaagtggtaaccatctttaatctgtcataacatccattataattttctacttatgatagtcacctaaactaaaatttactgagattgtcaaaacaaaaagaagagtccagttacaaggaacctgatctaaaataatcagattaaatattagatggatagtctattttaccatataatctcatttttgccccgggtaagaaggttgaataaaatatttcaagcatttttcccacccttactagtaagttttactaccaccagcaggaaagaaaagggaaagtcaggcaaggattccttttctttgtaacagtctcagtatttttaatttttttttactgtttatttgcttatttatgccaagtcttgaacagtctctggcttggctatgaatgagctaggtttcgggactctcattctgccctctctgagagagcagttctctgcttttgactcagaagtcagatccctaaaggaaaagcctgacaaagtatactgcctttcctgctctacctgtgaaagaactcaaagttcagttgactcaatggcaagtgggagacctatagaatagaggttctgggtgcacgtgcacattgactttctttaatttaaactttatattttgagatgattataaatctacatgcagttacaagaaataatatgaagagatcctatgtacccaatacttgattttccccaatggtaacctatagcaaagatgtactataatatcaaaccaggttttgcttatttttttagaggcagggcctcactctgtcatccaggctggagtactgtggcacaatcatagctcattataatctcaaatttctgggctcaagctatcctcccacctcagcctcccaagtagctgggactacaggtgcatgccaccatgcccagctaatatatatatatatatatatgtacgcatatacatatatatatatatatatatgtacgcatatacatatatatgttgagagatagggtctcactgtgttgcccaggctggtctcaaactcctgggctcaagcaatcctcccacctaggcctcccaaaatgctgggattacaggcatgagccactacacccagccacaaccaagatattgccattgatatgattcaccaattttattcagaattcccagtttggtactcatttgtgtgtgtgtgtgtgcacatgtgtgtgtatatttcatcctatgcaattttatcacctttataggtttgtgtatctactaccacagtcaaggtacagaacagttctaataccacatgtccctcaggttgaccttttataaccacatctaactccctcccactactcacatccctaacttctagcaaccactaatctgttctccatctctataattttgtcatttcaagaatgttacataaatgaaatcataaagtatatgtcattttaagactggcttttttcactcagtataattctctagagattcaacttgttgcatttatcaatagtctattccatttttattaatggatagtattccatcgtatgaatgtaccacagtttgtttaaccattcacctgttgaaggaaatccatgtggtttccagtttttactattacaaataaagctgatacaaatattcctatacaagttttgtgtggatataatgttttcatttctctgggataaatgaccaagagtgcaatttctggttggatggtagttgcatgtttagtcttacaaacagtcttacaaactgttttccagagtgactccaccattctacattcccaccaacaatgtttgagtgaaccactttctccatgttgaattttgattatatgaattaccaacattgcttttaacagttgatggctggcagccccatgtgaatcaagcattattgcctacttttccattcttgatcacttgggaaagacttaaaagacatcaaagatgacagggagaagtaatttctggaggtattttcagtggcatttttattcctgcttcttcatatcccaaactatatatgtaaactcagtgataggtccagtcatcaatgcatcacaggtgctcaatatctattgactggccaaatataagttatatgtcttctttcaaatttcttttacttaaatgttaaaagttatatgcaaatgccttcatagagttttccagcctttgttttctcttacctcagtcatctcttaaaccagtgagagcgaacagagttgaaatgagaatggattgtcacatttatgccactaagtaaatattgcacattcaaatgtggactacaatactaagccaatcatccatactctttcaacttacttgtttctccttggccaggtggagtttgctcctgatattggccttcaatacaaaggagagctgacagttgttttacgttacattcccccagaagagaacctgatgcttccaccagaacaactccaaggtagagtaaaaatcaatgactttgatcaatgacattctgtttctagaagtgtggtagtgggactcagggattggttgcattatatttctttcatattacacaaacaaaacataaagggtttggtgtcactgtcttttggggagagttgagatgtgtataccgtatatatagaagaatgcaggactcttacaaggaatccttgtaagattcatacttagaaaccagccttggtggtcagttttgttttatgtcccaaagatataggatcttcccccagggttgggggaaggcaggctgctggaggcaagtataggaaactgctccatggatttatgacattcacagctattcagggagtcttgaggaagaagttgatctagaacacaggatttaaaggaaaaaatcagatggaatcaatttataaatctctcttcccctttgtattaagctgtttttgcattgctataagaaataccaagactaggtaatgtataaagaaaagaggtttaatttgctcatggttctgcaggctatgtaggaagcataaaacaggcatctgtgtctgaggaggcctcaggaagcttacaattatggcagaaggtgaaggtggagcaggtgtctcacatgacaggagcaggaacaagagaaagagagaaggtgccacatacttttaaacaaccagctctcacaggaattcactcactatcatgaggacagcaccaaggggacggtgcaaaaccactcatgagaaatccaccccatgatccaatcacctcgcaccaggccccacctccaatagtggggattacatttcaacatgggatttgggtgaggataacatccaaactatcttgcccttcttttaccatcaattcttgcaggcagcctcctctgtcctcccattcactattactcttttcagtgtgaccctgtgcaagtaactcactatcacctgacctcaatttcctcacttcaaagggctgttgtgaagaataaacaggttcatatatgtaaggtgcttaaaacaatactaaataaaggtgctggttgtgatactggtttatatcattcatgttgaatgtatttcataagaaaagaaaagtgaggtggaaaagagatttctctcaccctaaaacgtaactgtgtttgggctgtagcctctagagctggctctgactaaaactgactatttgtaagactaaaatatcaaagggagttattgaattttctctttttgagttttggtgcatgtatattgtcttcatcatagttatttctcactaagagcaggaatggtgctccgggaaactcttaggcattccatgcctttataccctgtgaaaagatatgctttgtaagggagtgtttaaagttttaaatttatttcttcatttgtttcaacaaatacaaatgaaagacctatctggaaggaatccaatgggggcaaaaatgtttaaatgaataaaaatatacaataatgtaaaggcccaaattagtcagcaaatgaaatatatgtttgtagatgatctttgtaaattttgaaatggaactcatgatttatctatttttttttctctttctccaccattccctcattttggtggctgacacaggaaataagacttttaaaaagggaaagaagaaggagtcacctgtaatctctggaggaatactagaagtgttcatcaaagaggcaaagaatttgacagcagtgaagtcaggaggcacttctgatagctttgtgaaggggtaactttgttttagctctttttggatgatacttaataggagatgaaaggatctgtgatccacaagccactggtggctgtgagccttccgtgttctgtttactagaagtgtatgggtgagaactacccttacatgctggctcttacatctaaaataacacaagtgttgagggaactgctgattctagctgtcactctgtttccaacatatttcaggaattcccatcactcttactctcaagacagtcaacttttttctgtaagattcatttatcgaaagtggacaaaagtatgatttcctatgtataatgtatttatattgttctttattatcattttgtcctggcaatatgcaacaatcaccaaaatatcagatccttgatatttttctctcttgggggaaattgtaaaaagtagagatgtcagagcatccttgctggacttattcactgtcgagtgctttggagaggctccaagaccacctgctaggcatttgtgcccaagttgtggagcaaagggcagcttcctgagggaatgcagccttaaaatggatacttttgcctaactctaggcaactcaaacatcaaatcccttttgattcctgactactggatatttttctcttggaaattgagaaactaagactgcaaggttatttttcagtcattcaaacaaacacaaaatgcacatgtgccaagcaccaggtgctatgctttcaaaaataaataacatattatccctgccctcatggaactccgtaaagcacataaggtaaaacaaattcccatgatgccagaccatgaggttcattctttgagtcggatggcaatattgttcctcttcacatgctgtattggaaaagagtattttttcctacaaggaaatgggttgagctcactctcacatgttatttgttgttgttgtttgtttttgtttttgttttgagacagagtttcactctgttgcccaggctggagtgcagtggtgccatctcggctcactgcaacctccgcttcccaggttcaagtgattctcatatctcagtctcctgagtagctgggattacaggtatttttatttttatttttatttttagtagagacagggtttcaccacattggccaggctggtcttgaactcctgacctcaagtgatctgcctgcctcggcctcccaaagtgctgggattacaggcatgagccaccgtgcctggccacatgttctaactttggtaaagctagtagtggggagaagcagttctggggcctccccattggtgagtgtgtatgcctgaatcctggcacatcttcccttcactcttccttgcagtagatttaagcatagaagaaatgctttctttggatactgcagttacaatttgtgtcattagccctaccatccagtttaagcttctgctgctggaatgaggagatgactcccaacccgtggccacattgtgaccttgcaacggtacttgacatcttctggagcagtattcactttatcttgtggaaaatgtataaagcagaaataataaaagacagtatttttgttctagaaagaaaaacaaaagccaataactttccggtaaattctgtctataataatacttaaatattaggctgattctaaaaagacatgagatttttttaaaagacagtgagggagcaagaatagaccctctgtaaagtttaataatataaaatatatccattaacattaggtcggtctgtgagccaaaagaacagtggcttaaacaagacaagttttttttctctcttacatgtaaacaaagactgaaggtaaggtccccagtgcaggtatggaagcatcatgattatcagggacccaggatttttccatctcgttatggtatccacctaatgggttaggatagctgctcctgtttcagctatcccacacaaattccagctgacaggacactttccagatgtaagaagtagttttatcagcactacttcttatatcccattggccagaactcagtcacatggctattccagctgcaagggaggttgggaaatgtagtctttattctgggcaacactgtgctcaaataaaaacacagttttttagaggaatataaggagagaatggatattaggagataataagcagtctttgcttggtacatgaaattaaatcttaagtgacttaatgtatcttctttattgtaaagtcatttgcttgtagcacttttcgtttttgttccatgtactaattccatatgtacatatgtcttcttttctaaagtatgctccctgaagggggaaaacagccatttttatcacatacctagagcctcatacagtgttttgaccatagtcgagaaaacctaggatacaggcgttttatttgaagacaaatttcaggaaacaccagtgaggaagtggagaaaatgaaacaaggaagaaagagaagttgattaaaacatatgttaatgggcaggttaccactgtgggcaactggagcatgattccactagggaagcagtgaggaactctgtggaatataccttaggattgtcactttgagggacagggaagatggggaaattatccaccaatttctcaaactcatcagttaaaagttgccccaggggtattaaattccaagtaatcccagagtttcctacacataagctgagccagctaacacaatatcagataaattccttaattagaggaatttattccttgtatcaagagacacaagcacttgaggtgggaagctgaaagtatatcaggaacttcccatcctggctgcaagtcagctccaaggaggccaaaaagatttgaagcaaggcattcaatagtgtctattacaggaggtattttcttttcaagatggaaggaaggacctaaataagattagaaaggagagtgagggcattttactaatgtcccactgggaagaaataataagtcagttcactatataaatccagatttaagcatatagaagcctgggaaggaaaatcaaatagacacatcacacttgtgtacacgctgacattttctgtctgctgtcttattgatgatttgattgttttttctcatgcagctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgagggatttggggacccacagggatggtctgtgactaggcccaggtgggggcgctattcttgcagatgtgatgtgcagtggatgtatatatatagtttcagctaaatcctgaaattaccacaaatacttcattcctttagctaaggatctattcattgttaaaatacaaatataactacagtaactttgtatccttaggctagaagattggaagatatcatatttatattcaatcctttcatagactagcatttacaccttagtctaagtgaattgtaagtactttcttgggccttgcttcatattttgctcaggggatgattaccaagacagcataggcttctgatgggaggagagcgactttcaagaccaacattacttcatcatcttctcagttctgtccagcacttgcagctattattcatactggttgaattgaaaggaaatcattttttcataaaaataacaccagtattgttaaaaacagatcaaggaaacccaccactggtgccacaagacgcaactgtaacagggtgaattggaagagggattacagtagtagagcacgtgcattcccctaactctcattatcccatagcctaagccagacatagatgagaccatcagcatacaccatggtaaacatttctgttgaggaaggtcctatcactatgataattacttatttatagattaaggggagccaaaaatatctataccactaaaaggaaaactccccaggtcagaaaagtgcccttgttagaaaaagagagccaaattcatcccattcttctgtcatgttagcacagtccagatgaaccagctctctgctaaagtagggaggaagtgagtcaccagggccaccccgatttgcctcatatggcctaggcattagagaatagtgcaggctgaaatgattgattgattcaattctaacaccactcactatatatactaagtgagaacaagccagtaaaaggtactctggtgaaaaggcctgctcagaagttgatagataccttgcaggagagcaaagcatttcatgtgtgacataaaattttcccgtttcgcctcttcaggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactcattctgtcttcagttacatttttaggggaggtaagagggtggtgatggtgaagtctggaaacatctctggtatagacacaacgaagtggatttattcattaataataaatatgaaaaaataataaattttaaaatttataacttgaactcaagaagagcatgaactttatgtgttcagatctttgccacacgtagagcaactctctgtatcatggtttcataaaatccaacatctaactaggtattcccataatgcaaaacttaagtatgcaaaaatccatcagaaacctattggtgttgctcttggaaataaaaggcaaaagtatggtctagaactacaaatagtatttttaaatataggtaatgcatgtgaatagcacagaattcaaatagttcaaaattgtgaaaagttaagtcttcctctctcctcttccatatcagaaaatattgactgtctcattcttctttatggctacaagatattaaattatagggatgtatcaaatttatttaaccagtccaacccactaccacattaaatatggttaaccaagctatctatatttaatggcttttctaagcaaacttttccttcaaagaataaacactttgaaattcaaaatgaggtataaatcttacccaaccattccacttctgagtatttttcttacagaggtaagtgcatatatgagaaatgagtacatacaaggatatttattgaaagagattggaaacaatccaaaagcccatcaataaaggccttgtataatatcacatgaccctgattttctgcttcacaagtcactgcttcatctttgtctttactcattctctacaaaactattaaaaattggattattcagtgctcagttcttttctcctcactttatacagccttctaggcattatcatgtactgtactctcaaggtttcatacacttttcacttccaactcacatctctaacccagacccttcctgtcagccccagacccagatctaactgcccatatgacatctccaccaggatacttcatattttcaacatattaaaaactgtacccttcgtttcagtctccctcgcacccatgtcttcctgcaccagcgtgccctatctctgtacctggtaccttcatccacccagtaacagtaaccagacacctggtattgatctttggtttctgcctctttcttatcctgaggcaaaaatcaatcaggaaatcatattgagtctgcctcctaaatatctctagagcctgtccaattctcactgtctccacggcaccatcctagtccaagccactatcacccttctccaagattatcgcagcagtctcctagctgccgtctatgccaccaattttgtcctccctcaatccattcctcttactgtggccagagtgatttgtctcagcatgttattttaaaatgttcaaatatacagaaaagttgaaactttatagtgaacactcttatatccaccacccaaattcagctctgccattcacatttgactatacttgcttaccattattgatctatctgtccatccccagagcaatctgtaaaaccctcatggcttcccattgtcttgagaataaaatataaattcctgctcatggccctgcacaagatggtcactgccagtttctcccagaccatgactcccctccccttctcttcagccacagaattcatttttctacttatcaattgtgccaggctctatcccacctcatggcctttgccaggagtcttcttggtccatcttttcttcagcttgattcccattagtcatccaggtctaaaatgttacctcctcagggaaaccctccctgatcactctctactgaactaggtcacggcagcctgcctctatttccccttcagtgcacacatcacaattataataaattattaacgtaatgagtccttgaatgtctgtgtctgtttcctccctgtcatgtccctagaatgtaagattcagaagggcagagacaatatttatattttttacagccataatcccagtccttagctcacagtaggtaatcaaaaaatatttgtggaacaagcaaaaacaaactaatgtaacatcatagaatattagactgtaggcatctttagaaaccaccatttctaactcccaattaacagataaggaaactggggcccacatagatcaagaaaaatgtctgaattcgtttactgattggtcttttaaaagccaccttgctatagtcaccatgctgtgcaatgacacagcataatgattatacttaaaaataatgtatatttcaaaacagctaaaagagaggatttcaaatgttctcatcacaaagaaatgataaatatttgaggtgatggatataccaattagcttggtttgctcattccacagtgtatatgtgtatcaaaacaccacattgtactccataaatatatacaattattatttatcaactaaaaataaaattaatttttataaaagcaaccttccaacaagtactgtagatacaaccctagactgctgggcccagcttgtctcagcatagatctaagcacaaagtatgcttccggccccgcatgtcagcttatcagaagaagaggccacagccttgcatggaacgtcctactccttctttgaagatctcaactctcatttttccctcagataaatcaagttgaaaagggacatggacaaatccaaaaggctgattttatccatgcatacataaataacacatacaggatgtggtagattaattctgttaatcagctctcctttcatttatgttgttattgtcgctggactcatcaggatgtagatttttcaggtcacgaaaacaccattaaaaaagatattttgaagtaacttcatactctcggcctctttttccttaagaaatgttcacaaatgtatagctaataatcattaagtacttaggtaattaatgaatgaattgagcccacctgattcagtcatattagtgtcatcactacctactactccaaggtttaactttttttttttgagaccgagcctcactctgttgcccaggctggagtgcagtggcatgatctcggctcactgcaagctccacctcccgggttcacaccattctcctgcctcagcctcccgagtagctgggactacaggcgcccaccaccacgaccggctaattaatttttttgtatttttagtagagacggggtttcaccgtgttagccaggatgatctcgatctcctgacctcgtgattcgcccgtctcggcctcccaaagtgctgggattacaggcatgagccaccgcgcccagcccaaggtttacctttggtgagggaggagaaagccatggaagtaattagagtaaaccccacctttagaagcaaagtgtaatgaaatatcaagtcctagaagcatctgaaagtgagaactagtggcattttgggctgtgatcaatgtttgtttttctcccatgtatacatttcacattaaagtgaacattgtctctagaagttaccagaagggttttactcctacgatagtgtcatgtatgacctctgaaattgtggaaaaataggaggggaatgttcatacaggcaaaagtacaacaaaaattagatttggaaaggtttgaacaatagccaggaaaattgcactgcatcaaggattccaaaggactatctgaatcatctggagaatgaattgaatacatttattccagagcattgctccaagcctactaaacaaaatctccagcaatcccaatcattttaatcaagcttcttgggtgaatctaatacaaatggatcagagtttgagaaacactgcattagaggacaaattatatcaactctattcttcaaaccaactctacatcatgatggcttcttgaatttgatcttgaaatagtcgatcttctgtatacccagagatcattaattgcaaggcaaccatgaaggggtggaaagagtctaaccttcaactcagagaatactagttcaagtcttgaattgggtacttaccaaccatgagacttcagtcaagttaattactctttataggccatggtctatttgcctgtaaaattggaataaataggctactttggagtaactgaagatatcaaataaggtaatatatgtaaatatgctttgcaaattctaatccattgttttaaaaaggtcattattggtgagctagttctattactctgtggttcataatttcttatgcccctcttttcctacatgctgggttaggtcttaagcattctatgtacaattaagtgatctccagtgtttaggtgtagcaaacattaaaaaacctgtattttatgctaggttaccccttgtgggtgatagtaatatatttattttagactgaaatttcacacttcattggattagataataaatattacagaaaatgtttaatatcatggggagaaaaattggtcagtttcttggtccacagattatggaacctgcaagcaaaccatctttcctcccctttcttcaacactctcttccagtgtaatgaccatcgctttctatggcccattccctataccctatgtcaggaagataaaacctgctagcctcacaataatgttgtgtagagtcatgttctttatgtacagaaggaaatttaccatgctgtcaaaacaatttccatagaaatgcaaactgctgttgtcgctatgagtaatcaattgtacctcatttacctcactagaatttatccaaattttctgggggagggtttcttttatacttggaaaactaaagtagaatatatggttagtattgcctataaatgccaaaacactcatatggggtagtagatcatacttttctctcaagtattttgacacaaataaagatttgtctctgatttcctttttctctgaaggagacagaaattaatacagcacataaatcagatattttattacagtaattgaagcaaaagtttaaataattggaattttctaaaagatgtcttcttataggagggcaaagaactagatagatatttaaatctaaatattttatttttacctctttttttctttctttttattattattattattatactttattgtgagatacatttactttggggaaggattctgatttctctttccaaacattttttctacttagtcaatagttcattttgtctttacaaacttgaagctcgtttgtgcaaatccacaggaatccataagtcccaataagtagacttatttttaaacctttctcctttggaaacaaggaaggaagccattccatcacaaagcagtcatggcaatcaattcaaggttgaacccgtagttgaaatgattggggattgggtatgtatatttgtttccatcctttcttagtatttattattcataaatggacattttaaaagagagatcattggctttcagttgatttgaagaaagagatatctggacttttccttagccttgatttttgagcttccccgccacctccattaatttgtcttccataatacctaaatatcttcttacattgtccctctggctgatggcatgcacaccagaatcttaagagatgtccttcatgcttttttccacatgggcttatggaaatattattcttcatttttagctctttcctgtcacctcagagcccagttctgttagagtcacttgcttgcaaggcatctgaatgcacagagccaggctgaggagtgggctgctggggagcttcccagggtgccaaattataaagggtgctaaacatccctgaaaatgtaatgaggtggagagctcctctcaggaagaatatggtattagcaggaagaaataatgtctgcttgaatagatagatggggtgaggagctcatgcatgaagagcaatttatggctgataaattgcctcctaagacagatctgtttaggtgtggggcctttgttttgctgaatggggcatgcaaccttggacaacacaggaattgggaaggacatagggaaaagggacatttgccttcactggggacttctttcaaatctcttccaccaggcaggcccacctaaaaatatatgttgtacaaattcttacagagcatctgagaattgcacgacataatcagcccaagtattggcccagctctttgaatgcaccaggtctccattcctggattgaacataatagtcatgaggagactttttctctgggacctgaagataagttcagaggtttagtgggctggagaaggaagacacattttcaatatctaagaacatctaaaatcactgggtcgctgaaacattggaatgggggctcttctttaaaaggaataagggataattttccaaactgtgccatagggtgggtcacctacatgtgagtatgttcatttctgctttgtcatggcattcacctgcttcagctgccaatttactctcctacactcttgttctgataggacgttggtctcttttctttgtttgtttttagttaatagagtttatttctcagagcagtttaggtttacagaaaagttgagcagaaagtataagagttcccacatactaccttccctctgagtttctcctattagtaacatattgcattgatgtggtacatttgttacaattgatgagccatattgatacattattattaactaaataccatactttacattaggattcattctttgtattttagttctatttgttttgacaaatttataatatcatatatgcacaattacattgtaacacagagtagtttcactgcccaaaacatctcctgtgatttaaaccatggcaaacactaatctttttactgtctccatagttttgccttttttcagaatatcatatagttagaattatgcaatgtgtaacctttttggatttgcttcttttacttttcaatatggcatttaagtttcctccatctcttgttgtggcttgatagttcatttcttttttattgtggtaagaagacttaatgtgaaatctactctcttaaattttaagtgtaaaatatagtatttttatttgtttttaaatagagaaaaagacagaagaactctgaggaaacagtaacaatttttttaattgtttatttttcttttatttatttatttatttatttatcctgctagatttttttgttattattggccacaaataactgttcctgtgtgcttgccttgccatatttactaactgcttgtcttaccatgctactaattgcaaaattagtagtaacacttaaatacttaacatgcctacttctaagcttctgtatgtaacatgcatcccagacaaaagctttgtgccaccctgaacttgctgcaaattgggattttttcattaaatttactttcctaatatctctaacatgttctgagttattcctgagttcttttttaacttttattttacattcaggggtacacgtgaaggtttgttatataggtaaattgcatgccacagggttggtgtacagattattttgtcatcccagtaataagcatagtatttgacacgtggttttcgatcctctctcttctcccaccctccaccctcaagtaggccctggtgtctgttgttcctttctttgtgtccatgtgcactcaatgtttagctctcatttataagtgagaacatatggtatttggttttcttattcctgggttcttgaagatggattatatgtcacctatccctcgtgtctttatatttatttgtctttggaggaaagcacatttgctgaattgacacacagattggatgggtgtctggttgctgtttttaaaaatagaatgatgttgaacaactcttcttggtgctcagctattgaatctgccttcccatttcggtttttgctcacttatcttcctgtaagtctaaactctgaaacaattactccctttgccctcccctcaataaatcaagggaagggatcagaaatgacatttattgagcatctactatgtgtcaagtactttatgaattgttacgtaatttaaggctgttttttaaaaagacctaagaggctcatagaggttaagtaacttgcccaagttcaaagatagtatgtaatacagcctcacccaacatggagcttcccagttcagatcccaaagcccaatttctttgcactacactaaactgcaacccaactagaaaccttgtgtttgtcatgagctggagacttgcctcttacagtgggattcatgaaccaacagcattaccaaaatctgggagcttgttggaaatgcacaatgtggggccccagcccacacccaccgaatcacaatgctcattataataagatccttagttgatttgcaagaataatgaactgtggaatgcattggtgtacagaaaatggcagaattgatattgacacttaagactatcgcctgtcagttgtagttgatgccaacattgtcctaagatccttccatttgccagtcttttctttgagtcctttttattccttgatttttttttctcggcatacacacatgcttgattactaacatctttgtgtgtgtgtgtgtgtgtgtgtgtgtgtgtgtgtgtgtgtgtgtgtgtgttttctcctgtggttatcctgatgacatccctcagccaggtaatttgactttatttcagagtccttgaaatgaaagacctaaatattttttattctagatgattctgataacctgctaaatagaatgaggaccaactgactttggacacagtctcccctaaacttgaggaaatagtccctgaaagctttattccatagtactaatcaaacatcttctagctggtatcttctattttcaatcaagactcaatatttgtgttgctgctgatgacgaactgtagagaaaagcatttggataccaagttggcttaagtcagtgataaatgtgaggcttaacccaaaagtacattttggttaacccaaacttgaaagaggatgatgtattataaagaacactgagttgatagttaagaaacctagctccttctccaagctgtgctacttgctgtggcttttgagcaagacaagttctctcactgaacctcagttttctcatctataaaatgggagacttgaactaagtgatattcaaagtctgctcaagctctaaagtcctatgacaacttacatgtgctagaattaatttactctttgacaccattgattgtaagaggcagccttactttacataccacaaaggaagaaacaaatgttgtcaattataattttttaagatgttgctctggatattctacatctgttcctgcatattttctctttgctcttttcacactgttttatgccctaagaggtgaaccttaatgatttgcttcaatgtgactctcttaccttctggattttggttgggtttggacaaagaaagccagcagtaggagattgaatggtgtgaggaaagtgagactggtatagttacaagcctggctccctcctgctgggtcaccaagtgatagtggctacctctattcagggctatagttctttttaggttaccttctcctgcagctagagccacagagccactcctgccctccaatctttcaggcctactagtggtaaaggctcctagctgttgctagtatcaccatcccttgttgttttcccttgaccctgactgcacctttataaataatccctctactaatctttcctcagtgttgcagccacagtttcagtgttccatctgtttcctgctgagaccctaattgatacagtaattgatattaggcttgttctttaggaagcagcctctcaaaatagaattccaagattgtattgctcacatatttgagaagcattcccagcacttggcacattaatatgtgcatagtacatgttaacgtctttgaataaaaaacaaaccaaaaaaatgtcttccaatcgtagtgcctctgttcactggaagaaatataaggtagccaaaaatcaagacagtttttcttatcacttttatttctaagatattatttagtctaggctcagagtctataactcaccaatcctttagcaaaactgctaatcagaattgcgtgggctctcgactagtaatgactgagactactcagtctggaataaaagctactgtgcctttgaaaaactccattgcattttctttcctaatttctaatttactaattggtctctatagagacaaaggaacaagtgtctcacctctggccctcctctagggaaatgctactcaaggtgctggcccatgataagatagggagcttgcatcagaatgtaaatcagtgtgtggcttccttcatggaaagttttgcaatcaaaaacatcagctgaactaaataacaaatttattgacactgttgatttccagtcttgggcaaactccttatctccttgtaaaccagtaataaatggtgcagggaccagcaactagtacaaggaccacattctgaggagcattgctctagagggtcttggaactcagtcccttcacaaagttcatatatttgtgctatattgctgccacttgttgagaaataaaagtatttcttctctttctggtttttcaagagagagagaagtaactcctcttttgaagcctggaagttcatgcttagtctcagaaggcatcagaaatccacttatcctgcccaagagtcaaacgtaatttcatgaaactaagcgacacattggaaggtactcaagagagaaagattcagatttgatctgtgaccaaacaatggcatttcagttccatttgaagtcaatttgttagtctcacagcactgctgcctaagcacagcaccatccttcacagaaacttgttctgatgtagagagagacaatacaacatttcaaacacgatgcagagaaattaaattttcttcaagctccaatgcagccatagagcaaacagaaaaacaaatccttaagctgttgagcatcttcagaaatgacaccatagtaacagaaatgcatctgtaccctgcacattcattagtaaaattgattctgatgaacaaagctaggtgctttgcaacattcctgtggctttgtcctaaggagaaacaagtgccatattttaaatgagttaaacataagtttaactttgtaatgcaaacactaaaaaccttggccaaaggcagagaagcaataacaagtgtttctccaaagggggaggtgtattcccatcattggttataactgccatctttctcacctcgaccaaaacggtggttctcacccttggcttcacatgagaatccccttggaagcttttaaaatccctcaagtcctgtctgcacctagaccagttatatcgtaatctctgggtgtggcaccaaatcatcagtattttttaaagctccccgagtaatttgaatgcatatccaaggttaaggcataaagtgtattgagagggctggtaggccaaggttgtcgtgcttgcagtcttgctgacaaagacatcccccttactgcagcaacccttaggacacagctatacaagaagccctcagtgtcccttcttcagttactgtaagtcccagctttaaagctgttaacaagcaagtaaagctgagaggagatgaaatatttgtgacttcttgtgaagattaaatgagatcatttgaacgcagtgttacagtttagatttttttaaatttaattttaagctcttggatacatgtgcagcatgtgcaggtttgttacataggtaaacgtgtgccatgatggtttgctgcacctatcaacccgtcacctaggtattaagccccgcatgcattagctattatcctgatgctctccctccctcacagtttagagtcttgatgaaccaaaagggtctgctcatccctgctcttcatttctgattaatttagctaaggatacagaacctaccaaaagaaagatagctgcaaagaacaggagcagatgcagcacatgtggagaaatgttcccttaagtgtggggtctctacaaggcacacagctattaggaacagtccccacaagacctaccagagttaagaaagatgccaaattttgggttttttccactcctttctattccagattccatcacaattccagaattatattaacaaacggggcttttcagtttaaggcagtacaatgtttggtctttggactcctgggtgtcctaaaacttcttcaaggggttagcaaggacaaaactatcttccttacttgctcttttcactgtgcaaaactgtagcactatggcaggaatcaaggcagtgcatatttttatcttcatgctttcatagtaagaaaagtaaaataccagttttatttaagaatatccctgatgaagcagtaaaaaatagtcttattaaatcttgaccctaaatacatatgttttaaatattttctgtgcataccaaagtatgatgcattttcagcattctttttattttaaagaacaaataacgggttattcaagcttgagaatttggcagacattttttcaaaaacgaacaaagtgagcctgtcacttcagggaaaacaattggcagtacttgttgccaatgataacattaaagctttgaagcaaaaattagaatttttgaaaacttgtatctaccattgtgactgtgacagcttcctaatacttatacacttttctgataagattggtgatgacattaactaatgtgatattctaatattgtgtaacaaaatttatcaatctttggaagagctacttgattcagtgaaccagtgttttctaaatgatggatgcatgagttacaaaattgtgcatagataaaagatacattcaaagcacaagatagaccagtggattttaatgcaacagagtacaaagagttttcatatcaccattaatctttaaggaactaccacttgttgacttttggtgaagtgtcaaaaaaatattcacagttatctaaataggctattaaaatactcctcccttttccaaatacatatatgtgcgtgtgtgtatatatgtgtgtgtgtgtgtgtgtgtgtgtgtatctgtgaagccagattttcttcttatatttcaatcaaaataacatattgcaagagactgaataggaaagcatatatgagaaactagctatcttctattatgccagacttgaagagacttgcaaaaatgtaaaataatgctgctcatcttactttttggttttgcaaaacatacttagattttctcaaaaatatgttatctacatcatcatgcaataaatttattttttgaaatgcatcgaaatataatttttaaaatttctctgttttgatttctaacctggtaaatattgagagatgtaactcacacaaagaaaagtactttggaatccttcaaaggtttgagaactgctggtttaaggaaatttttatagacctaggctgttcacatttttgtttttgcagacagttaaattactaattcacccagcttggtgttgtggaagcttgattttaggctttgttaaggaggtctactttgatttaactgaatcctgaatcttgttctttacttttgaagagtagtcctgaattttcagtggaagctcaacctgttcactgagctcctttaacttgaaaggatttgacctccaaactatctctccagcacagatcagctgctgagatcactgctcagctcaggtctttcccttcagctattttgttttcctcctggacttctcgtagcctcactctgtgcatgcacagctcaggggtcagttaaagatttaagggcaatttatatgcacatttgggttccccctcccaaatcccacccactggctttctcctttcacatatctcctccatttccacactctctggtcatcctgccgtcatcctctgaatcctcagcccagtaagagtacagccttctgcttgagttccacatccagtacactagcaaatggaaaagtcctcaagggaaaagccaaccaaatgtgcatgttacccaatgtgcttacattctttcaaggtcatagttatttcagactctgcctgcttttggttgagtgccaatgagttccagtaacttctctttctttattttgtccaaagttataattgttatcagcagggaggttagtatgatatggggtagtctgccattaaatgaaatttaattcctgtgtcttcccattttgaactaagattagcaaggccaagttctcatctgtggggtgacagcagagccataccagacccttgaacaatatatcctccttcatctgtgcagtgttctataaaatctatttccccacaatccactcagcaagtctggtttaatatcctcttgccggggtggttctgatgttgggccaaaggccatcataacatatccaattgtctcacaatctttttttttttttttttagacagggtctcattctgtcacccaagctggaatgcagtgtcgtggtcacagctcattgcagcctcagcctcccaggctcgagtgatcctctcacctcagccttccaagtatctgggaccacaggtgtatgcctccacacccagataatttgtaaacattttttatagagacagagtcctgctatgttggcccaggctggtcttgatttcctgggctcaagcaatcctctcaccttgacctccgaaagtgctgtgattacaggtgtgagccaccacacctggccaattgtcttacaatctaataaaatcagtgtgttgaagacatatctgcactcccatgtttattgtggcattattcacaatagccaagataaggaatcaaactaagagtccatcaaaagatgaaagaatatttttaaaaatattacctcggttacctctgaaaatattcttgccttttgacaacagcagcaggctctttttgaatttccctgcccacacgtagagccaaatactctctaggaagtcctgtctccttgtggagttgatgatgattcctgtgtaacctgtgctagatacctcaaggcaggaagaaccaggcccagcctccaccataaggtcagttctggtcatggtagggggctggacctgactcttcctgtctcggttgtctaagataggttacacaggaatcacaaggaatgtcagttctggcactaaaacattgtcctctgaaaatggaaacctcaaagcctatcaagttcatccatgtctctgatgtctataatcctccagttacaggcatgagctgtctccctcactggtcttgttgttgtctcattctcatactgctctgagtgtccccttgcccaactctcttccagactttgatgcctctggactattgccgtacacacacacacacacacacacacacacacacacacacacacacatttcatagtaaagtgaccttttgccttagtccacttgtgttgctataaaggaatagctgaggctgggtaatttataaagaaaagaggtttacgtttacttggttcatggttctgcaggctgtacaagaagcatagagccagcatctgcttctgatgagggcctcatactgcttccacttgtggaggaaggtgaaggggacctggtatgtacagagaacacatggcaagacaggaaacaagggagaggggagtgcagttggaggctctttttgatgaccagttctcaggagaattctcacaggaactaacagaggaacaactcactccttactgccaggatggcaccaagccattcaggagggatgtgtccctatgacccaaacatctcgcattagaccccactttcaacactgggaatcaaatttcaacatgagacttagaggagtcatatatccaaaccatagcaccttcctatagctttagtatcttttcaaaatattcttgagtaaattcttgttttcctctttgtcgcttttcttacagcaggttgctctttcatactttaatatcacttggttgagaggtaatgtcaacatctgctcaattccccacagctccttcttaattgatcattctttcctaatctgagcaaaagaccttctctgagaatcctgccatctaccatatcactttccatcatgctctccttacagtcacctatctatacacagttatctcctccactctatatatccttggaatttgactctcactcatctcctttgccttaactcctgccagtatccacatcacccatttggataatttattcaacttcctaacatcacaatttcaatgatattttcttcatctcttccaaatctctcatatctttatactgattatattcactcttaaaccacattaggatcattagcctttccctatattctttgaataggtcagtgccactactgttttttgtttttgtttttgagatggagtctcgctctgtcgcccaggctggagtgcagtgccgcgatcttggctcactgcaagctccacctcccgggttcacgccattctcctgcctcagcctcccgagtttctttttggactaactcttgtccttgtgtgtaatcacacaatccattttctcaatactacaaccaactccctccccttgtcctgccaccatacctttgtcacaaccatctacccccagattagtctttcagtatgccttctctcttcctcaacctgtgtgactaagcattgctgaagaaaaatggtcaattgtactgaatgattttatcatggcttataagatatgtcttcaagagatgcttgatatcactgttaactgtggaattgcaaggaagagaagtccaagaaatccagtgtttcaagactacgcttttaattttactgtctgtatcattaaggacttaattacagagaatagagtcaacgcaagctagttcaaagagaaaggatattgttcttatctagagtggaaggttaaaaaaatagactttatgctgaccttccataaaaaagtccctaaaccacctgggactgccaagggaactgctaagaagttgtaaaattgggaattttcctaccaatttgggaagccacaattatatttgtttattctagaactactccatgttttctaccataaagaagccatgtccctcattattaaaacgtcaaaaaaataaaagatgttggcgaggatgtggagagaagggaatccttatacattgttggtggaattgtaaattaatccaacctgtatggaaaacaatatagagatttctcaaagaactaaaaatagaactaccatttgatccagcaatcccacccctgtgtatatacccaaaggaaaagaaatcattatacaaaaagacacttgcacttgtatgtttacagctgcactattcacaagagcaaagctatggaatcaatctaagtgtgcatcaagagatgattggatagagaaaatgtgatacacacacacacacacacacacacacaatggaatactactcagccataacaaaaagaatgaaatcatgtcctttgcaacaacatggatggaactggaggccattaagtaaactaactcagaaactgaaagtcaaatactatatgttctcacttataagtggaagctaaataatgtgtacacatggacatagagtgtggagtaataatagagtttcagaagggtaagggtgggtggggatgagaaatgagaaattacttaatgggtataatgtgtacactatttgggtgataatgataccaaaagcctagacttcaccactatgcaacatatccatgtcacaaaattgcacttgtaccctctaaatttatgccaataaataaataaattgccatgtccccagttaagaagttgtcagcagctatgggaactggcagaagctagccttcaaaataggccccagtgatctttacctcttagtatccatcctattgtgttgtcctcttccccattgaatagggctgatctgttggaccaacaggatactgtggaagtaacagtgtgtgccttttgagactatgtcataaaagatattgcctcttccactttgccctttcttggatcacttctaccagaggaagccaactaccatgttatgagaacattcatgcaacactctgtggagaaatccatgtggagacaaatagagatctcttccaaccatcagcaccaacttgccagtcatgtgagtgagccactgtggaagcggattctccagccccagtcaatcctttgactgcagtcccagccaagatatgacagcaatctcaagagagactccaagccagaattggccagctaagttgctcccaaatccctgacccacagaaattgtgagagataatatgtttgttgttttaagacactgatttttggggtaatttttactgcaggaatagtataggtatcaacatcctgagcattaatccttgcttcaatgtgcactgcctttcctctccttcactgctcactccaatgatctaagctcaagagttgagagtttgtagaggtaaatctgcagttctctgtgaatggactggactcttccaccttctagttcatccttcactactagatttctaataatggtttctattggactaacctcccacagacaacaactatatctggatatatatacatatatatatatacatacacacatatatatatacatatatatatatacacacacacatatatatacacatatatatgtatatatatgtgtgtgtgtgtgtgtgtgtgtgtgtatactacaacctgcatacatgtgtagaagttctgcagtaccaaattgtaagcaagcagaattaggaactgtttttttttttttgtttgtttgtttttattaggtccaaaaggtacatagaaaagttctgcaagatttccagtgggaaaccggttctctagagagaggctattaattaatctttagaaatgtccccaaattttgatgcagggtatttacttttaaaataccatagtggattcattgatcttcaaatagtctgttgatcttgttgggaaaagtgcttgcaatattccaagtcatcaggtaaattggtttgaaggaatccaagtagttccttaaatgtcagctcatcttcaaggtttgaacctttcagggtatggggcaaagggcacaggctgacttgtcaaagcaagagagctttaacaaaggtagaggcagatatatgcttgcttaattgtaacaaatgatctcctgaacttttccttttttcttttatttccataagtttttggagaacaggtggctatttggttacatgagtaagttctttggtggtgatttgtgagattttggtgcacccatcacctgagcagtgtacactgaacccaatttgtagtcttttatccttcaccctcttcccacccctattgaacttttcatggtttccagttggtcactatttgacattcctctatgagccatgccattgacctttctgatacatctgaagaagacagaagtcaaaaactggcttctagtatgctctgtgaacaaaatcatgtttgtaaatagagtgtaaacctattggcagttcagcaatcgccctgcctaatattaaaaaaaaatgttaaatctgctttctgtgttaaatctctgtatgttagaatttatctattgtttctataaggtccaaaaggtgcacagaaaagttctgcaagattttcagtgggaaaccagtgggaaacatcattcacttagtcattttatttaggaatagattgtgaaccaaactgatattctaaaaatggaggaaaaatttcaagatttgcatgggagaattgaggagtctggctactggttaaaaaccaatgtgtgatttttcaggcctgatcataggcgatgacgaagactttacctggcaggcttcactgggaaagctgccctccacacaccagacttggtgcacagccagcgtatggcagtctctgtggggtgttgcagtcaaagactcagaccccctggccaatcatgctctttcacatatttacattcctagccctgtgccttcatttctaggccctttatctgaggccttgggcaagaggtcttcaggttcctctgctgagatcttatggggtaaggaaaagggaaaaaatttgaagatactttccttcactctgcctcagtgcccaggacttttccactcctaccccaccacatgactccagggtccgtaaaactgccagagccttttgttcgggactccctcaatataaagatgaccccacgtctgtgctgctccacttgaatcttgaccagcgtgctgtcccacaggggaaaatggaagagtgaagttgatgcttcctctggttttagactgtgactgaaggcttaactctttcattttcagcttgtggctttaattggctacttgaacacctgacagctcagctctctcccagctcagcagagctcctaaaaagactaattaaattttttccattcttaaaacaccactaagaatcacaatcctaaaaccactgaccacactgaacaagtatggctggtgcttgacaaacaaagtgagttctactaaatttgctccaaaacattttgttttattaataaaagtcttacttaaaaaacaaaatagaaaagagttaggtgtcacattgaataacatgttgatagcctgtgtatggttatgggttctaatttctctacaaaatcaagcagccatgatggagtaaagaaagttagaaagagtaaatatggtcatataattttttgaaacacttccaagtacaaaaagcagcatgctaatttttaagtgcaaagaaagctcataataaaatagacttttaaaattacaaataaaatctgtacatcaaggatatttttaaggctttcccgtgtgcatgtcactatgtagacaatgaagaggaattgccaagagaggaaccatcatgtcaggtgttacaggtctggctcatttcggcttgtaggaccatctcttcttttctcaagggaaaagtgtcaatcaggttgaacagggccacaggcatcaccagggagacatagcgctctttgtccatgccatgcttatccactagcaccatactgaaggagtagagtgggattcgcagcaacagcctgtggcagacaaagaaaagaggagactaagtcaaaccatgactcccaagggtcctggtggatcaaccagagccttactgtgacagtgtgcagagaaagctttgatacaatgaaggactgaatcatcctttagaccctgtctactccaactgtgacccttgaaccagcagcatcacatgagaacttgctagaaatggagactctcatgcccaaccccaaacctactgaattagtgtctgcattactatcaagatccccagatgactggtatgtacctgagaggttgaaaagcactgctttggttttagattatagtcaggaagacttcaggcgtacaatggtgccacataccaacgtttggtacaaggtgcatacaaggctaacagattttttttattaaattggaatcaatccaagtttggaatcaacccaaaacccacgtttgctgactagtgttgcacgaccacatacacactaggacaaagtcagtgattatgaacaggggtgattttgctccccacccccaggggaaatttggccatgtctggagatatttttggttgtcacagtggagagtgaagatgtgaccggcatttagtgggtagaggccaggaatgctgctaaacatcttgcaatgcacagccaactgtccccaccaaacaaagaattatctgttcccacatagcaatagtgccaaggctgagaaactctgggctaggtaaagctgattgatataatttcccagcatgatagttctggcctgttcagtggccagctcaggactgcagagttataagggattgagcttggtctacagcccatgtattctgacttgattaatcataatttgtaccccaaataattccaaaaaagaatatgaagtggtttcaagtgtctggtgttctttctgctctaccacactagaatttaaactaaaaaatatgatttttatatcaacacaaacatatttagatgggaatagctagagaaagcaaacaaacagataagctgagcccaatgaataaatgagcccactcagtctcttctccagatttttttttcagtttagatattttgagattatgtatgaggcagaatatacactgccatctggatttaaagtaaaatatgttttcctcatacaaacagatcaaggttaaaaaatcattacatagaacacaaactacttttttctgccttttaagagggagtttcgaggaagaagggaataatttgtattttatcccagtggggagctaaattgccagttcactcccagtgactagaaatgaaataaagaggacatgacaatacctctgccaggtttcctgcagtgctaagaggggagctcagaagtagatgactgcaaagtgcattaatgagttctgaacacgcgaatgtaggctgcaaaggtgtgaatgaagagataaaatgctctgcatctttaaggggaaggatattgagttttcttttgggagcgtggaggagttctggtacagggagctctcaggaaacagaggaatagggaatgtggtggctgaagcctgtgggaaagggtgaccaataagaaattggagcattcattttttttatagtgcttgtgagactaggatgggaacccccaccaccaccaccacggtgccaccatctgctaccatacacattcctgtgtaagtcttgtgccttcattgacacagaatgtaaagagggaaaactgtcatgggaagagctgagtggttggatcagcaggctagcagcagccacaggaatgcatcccactagggccgaaagaccacagaaatcttggggatgaatgatcaaacaccacacaaaatcggggatgaggtgtgatgccgacagtatgcctgagttacatatgtgtctgtcgtcagattggaaggagttcttcctggaaagtcttccagggaacactgtagactcaaagaataatgtgggtatagaaactatggctttcttggtccctgtcttccttgagattgctggaaaattcctctggaaagcatgaatcagatcatacctccagataaaaaagaaatgagggtaagaaagaaggtaggcggtgaccctgcaaccccaggcacccagtctcttctttctgttgactcccttcaagggttttatcacggccttggtgctatttgaaaatagccagacaagagaatttttacattatgcaggcattatgcttttccttctcctcttttgcttcccattctttgcctaaatcatcttttttcctctgcactagactccaaggtgtctaaaaaacacctttccaattcaaagggaaaaagttctgccaagctctttgtttctcactgatatgtttgataacacaggcatgccggcctgacacagaatccattaggtaatgcacctgagtgatcatttctgtatgacatttacctggactatcatccagctgcaaaatagtgattgaccctttccttgaaggctgctgggcaaaaattctatttcaaactgtaaaggctttggtaaaaaactaggccagtggtcctcaccatgtggtctcttgggagctcacgagaaatgcaaattctcgggtacgaccagagacctactgaatcagaaacacagtttagagcctacagtgtagactccagcaatacgtattttaacaagccctccaggggattctgatggaggttaaaaatttgagaaccacgacataatgtatttaaaaattatcttcagcctatagaagtctatggtagccccaatatatacaatctgaatgacaagtattttttaatcacatttttctgttcttcaagtagattaaacagtttaaaatcacatcaagattttatgaagatgacatacacacacacatacacacacattcaatccaaagaccattcagaaaattctgcaacaagttttaaaaaatcattgacacaggatatgagcaagtagttctaaataagcaacagcttcataaaacctactttgaaaatattcaccataaatatttagatatcaacacaactctctgtcttaagttttgtacacttcaacttgaagtatttgtatactaactgtagatatacaatatacttttaaaagctattatcacctctggaaatagtaaggctgtttcaatgaaattttgagtcatttactccacttagcgccaacatggtgccaggtactgtgctaggtactgagtagccaatatttgaaagctctgctactgaagtcggtatggggaggtgctacatgcaaatgcagtaaaatataacaaaaacaaaagcatatgagtgtacccagccttctccattcatcagccgactaaagagaactcatgaatcatcttatttttcttccatcctggccctctgagttttttctttctttctttctttctttttttttttttttttttttttttaccttggtaggaatgtggcagaatctttttgggtggaaagtggtacaaatcaaacatgggatgggtcaaaggcagctggaaaacagggaaattagagaaagaagctattgtgtctatctatagcatcatttgctaaggatatgtttctatcatataacctctcaaggaatttctgtgccttctgaacaggtgtgatagggtttaccaagtcccatttcattttcttctttctggcaatacagaaagactgcatttcccagcctcccttaaaagtgaattgcaatcatgtaactagttctggccaatgaactaagagagtgagcaaggtgtggcacctccaacgtgaagcataaaggagtcagtgtgagtttttactctctttccccacttttgcagaagcctgaaagccacgtgttcgagatgtttgtaactgcctgaggccctgagagacagggagcagcctgggaccctgaaaacagagatctgtactctcccatgcagtgtgtgagagaaaaggctgggtgagaaaggaagattttaaggagttttgctttagcctaattatcgatttcacagtggtcaagagatgcaagtagaaatttgggttattctgaaattaccttttggttgttgaattctgcttctttaatacatcattattcagagactaaaatccatggctccaactttgtaagggttatgaaactaaaatataattgttaaaataaaggtatgaacaagtgttctggaagcatggagaaaaaagagaccaagcctgggaagtctaattggatgcatgctcttctaataagaccatgattgcttaagtcttttcttcaggtgctcctctcctaaccatccttcctccaccaaccacacacacacatacacacacatgaagcaaaaacggttggttggagggagtaagaaagaacactggtaattacccactgcacaatttatttgaacaaacagcaacatactgattagtatggttataacactcccagaataaaagcaattaaacattgaaggttgcctgaactcaatcctgaatagaaagaaaccagggaacctaatcagttaaaaatgcattcacaggggataagatttaagaacagaacttccccctacctgagctgcagcgctagggctggaggcataatctttgctcctatcctgccaatgagagtcgggaacacacccaccagctccaccacggtgatgtgtcgaagatcaaggccacactgtgcttgctgggaaaaagaaaacccaacaggggaagtatgagcatggctaaaaaagacatccttatcaaactagaaaccgacagaagcagcactggcctgtctctggaagtttatttgctcactctgaactgtcctgaaaacagatgagaaattggggttaagatagtggctataaaacctaaatacctttgctagaggaatcattcagatatggcttgacagtgggattttgaaaacctaagcaaaagggcagtctatgtatttccagacagggtgagaccttgagtgagtcaaatttcctaaaaagtatccaagaccaccccagaggattctaatttttctttgcaaggagagaagactatttccagagtccacttctctgccctgtttccactctccacactcccctgccctatgccctccacacccaatcccaggggaaaagaggataaaaggttccaagcctctaagctggctcttggcaagaaccttgggaatgtggcccagtcaaccacgaggagggctcatcaggaatggcaatggcaataaaaaaaaaaaaagtaatgtaagacaaatatgatgaatttggctaaatgggaaaagaaattttgaagtcttgaaagacgaaaacatcaaatatgttttaccaaaattccactgaaacgtccctatatgaggttacagaactggttgaaaagtttaaaaagttagaaatagacttttgtattactctcactgaaatgcctaagtcaatcaaacctttctttgaaggctctggttaaaatgcaaatgtaagtatatttggaggaggagggcacaccaaaacatcttgatataaaatatcttatccaaccagttgttaagttagcaagtgtctgaagggatgggacagactagagcaacgatggcaatctttctctgtaaagggccagagagtacttcaggcttggcaaggttggattgcctctgtcctaaccacttcacccatcattgtagtgcaaaagcagttgtagatcatgcacaaatgaattagtgtggctgtgtccaataaaagttaatttaccgaaactagccatgggtcaccatagtttgctgacacagaggaaaagcaagttgtttggcttaattcattttcctatggaataagaagagatgaggaaatgcatgatcatggaatatagcctgcaatgccagtttcccacaaaagacagaggtataagcttgtgttttctgaagagcaagcccctggcttggacaaggagatacaaggggaggtaagctggtggggaccaggggtaaagatgcaatgaatttggttcctatcaagggaactcacaaaaattttatatggctcttcagagttcataggcaattcttcaagtacgtgggaagagtgaaaagagacttattattatccattttattaatgctgatatgagaagtaaattgtagcctttgattaaatcaatactgttctaagcacttagttctatccactgtaataaatgaataaaatagtctcaaaaaaatgtgcagcactgtatccatggcacagcatacatcctgcctctttagtattcagtgaagttggccactcttttgcaaaccagcctcaggacaaaagcaagcaatttctagtttgatccttacagtttctagtcagccttccccacacacccaagatgttggttgcctcatttagtagctacaaaatttacatagctgagaaggacacatttcccagaaaagtgaccctcaaactttagagtgcttaggaatcacctggagattttgttaaaagtgtagattctgacacagtaggtctgggaggggccctgagaattggcatgtctatcaagctcccaggtgatgctgatgcttctggtccggtccatggatcacacgttgagaaccacttttctaagaaaaaatggctgtcaccctctgagtcaaagaaattccctggggaaaaatgtgggcaggcaaccaattgattgcttccagccaggcatatcctggacaggtttggcaaagacaattgttctgtggctaggcctggacagcatgtcaattagacttattggtgaagacagacaaacctcattagttggaaaacgattgggttaactctaaggagtcaatgttaatcaggttatggcccagaaccagaaatgaatggtggtagctctaaagtgccacttcctgaaactcactgtaagtgcattaggcactgaatctggcctttgcttttagtgaaatggctgggcccttcctgttaaaggtctccctctcaccttggccctgcctcgaggactcacctgcagcattcctagctggagccggtaaaggaggtttcgggctgtgggtgtggacacaatgaggagtctccttttctcataaaactgatccagaagtgcagctgccgttctgacacccacattgacgttcatggctgtaatcagaaatggccacatgggtcagaaaccttccacttgttctggctcaacagagcctatgatgacacacagaaccatttgtgtaagaagtaaaccctgagataaggattcaagtgtaaacagtttatttgggaggcagtcccaagaagcgcctgtggaggagtacggaagtatattcacttcctcttgctgctgtaacaaatcaccataaacttagtgacttaacataatacaaacttattcttttagatactgcaggtcaggatctaaaagatcctggtctcatggagctaaaatcaaggtgttggcagggctatgctcccatggaggttctaggggagaatctgatttcttgtctttttcagcatcgagaggccacattcattccttggctagtagtcccttcctccatcttcaaagacagcagtgtagcatcttcaaatctctcttctctctgacctctccttccatcgtctctttctatgactctgacatcagttctgcctcctttatataagaaggcttgtgattacattgggcccactgggtaattcaggatactcttcccatttcaaaatccttaacttattacatctgtaaagtcccttttttcatgtaaggtaacatattctcaggttccagggactaggatgtggacatctttggtggaccattattctgtctatgtcaggaagtgagacagtgaaggaaagaaaacaataccaattggttatcaagcaagtttttgctgtgggcatttggaactcactcccactggggaactctaggagatgatatacaacatacctccagaattaacccactggagggaactggagtatttatacaattgctccatcattgctgagggctgcttctggggcactaactctccatcacttccagctggctctgtgcatgggctgacaatgctttcatagccaggaaagaaatgctctcagacagacagacccagttaattgcagtaagtagccttttgaacacagatgggaatgtgaaaggcatatgggccaagcaccatagtatctgctggggaaaggggtgcagagaggcagaagggtaagagaatgggcagtggccaggctggctttggaatggctcagaatctctgaagtctgcctccttggtgcagaagggacaaagcaatgtggggcacaaaggccacagagcaaacaacacaggcaaacaggacatgggacaaggcggttttataataggtcttccctttaagcaaataaatgacaactaattccagctgttcaaggtcaatgaaggatgtcgtatagataggcaagcaaaaggcttagccccagagaagaaataataagagaaaaactagtagatgccatgtatgatttataatcttggttttcatatttcacattttaggtttgcattgaagtatttgttcattcacacattcattcattcagccattatatactgagtgcctgccatgtgccaagctctatgctaggtactaggatgtcacactgagtgatacacagttcctgccctctttcctgccctcttccctgccccagggactcagagtctaggatagctctggtcaagagaaatacaatgtaagccactatatttaatcttaaattttctagttgcctcattaaaaaagtgtaaagagaccgggcgcagtgtctcacatctgtaatcccagcactttgggaggccgaggcgtgcagatcacgaggtcaggagatcaagaccatcctggctaacatggtgaaaccccgtctttactaaaaatacaaaaaattagccaggcgtggtggcaggcacctgtagtcccagctgctcgggaggctggggcaggagaatcactggaacccgggaggcagaggttgcagtgaaccgagatcgcgccactgcactctagcctgggtgacagagagagactacatctcaaacaaacaaacaaacaaacaaataaaaaatataaagagataggtagaaatgattttatgttttatctaacccaatatatccaaaatatttcatttcaacatgtaatcaatataaaaaattaagatactttatattctttttcacactaagattttgaaattggtatatattttacacttatagcatatctcaattcagaatagcctcataggtggtgggcatgaagtccttaggtagggagtctataataggtgtgttctttctactttaatacatgaaattgaagaatctcaggcatttagctgatggtatatatgtctctctgtcacttaactctaaatgggggcttcaattaaaagaaagtgataaagatgaaagggtgccaggaaatgagaaaaagagaagtctataaacaagagatacatacataattttctggctagtccaagtttcagactcattacccagcccaatttttcttcatcaggaataagagctggcataaggctttgcctgtaccaggcactgctctattccactgttccacagatgacctcatttaatccttacaactcaagaggtagatgaggtattattttcttcattttacataggaggaaagattccaaatgcccaaagtctatgtaactttcatgccagtgatgcaaagcaggtatgatattgtctctacatggcaatttactagctttataaataagatccttacatttctagaacaaaggaaactagagcaaattttgctgattcataatgtcaccaaaggctggccctaggttcctaccttgagcttcttccttagaggacatgaaaaggaaattagaggataggcaggggcaagatggatggcagatgagatgagctgcagcagggatctagggactatgttcatccactcagataaagagggatggccatgaacttctcaaagtatatgaagggaaacctctcttgcactggaatcaagaaccaaggggtttacaggttctgctgcaggctggaggggcggcatacctacctgcacaggtgggctccgtgccagaccaagccaggttggattgacatactcgggcagggctaccctggagctcatagccgccgatgcaggagaactcacaggtggctccataattatcaccgtcgctggagcacttcatgtaaccattctctggggcattgagtttgccacagcgtttgactgtagggacacaagtccagaggggtctcagtgctgagctcccatccacagagtaagcagaaaaggtgaggatgcagaggcatcagctttgcaatcaggcttctacatcagcctgtgaaatgagtgagggaggagggatgactatttggtcagtgagtgagtcttgcaatggtcaccatccataccaatgagaccactgatatcaactggtttcgcccctagtgttatagatgaggaagtgaagtccagaagagtaaggagtaaagatggttagcaattagttgcccaaaccatcaggcataaaataatccttaaaaacattttctttcataccaatggtactagaacactaaaaacatgttctcctggtggcccaaattagggggctcctattcaccctggttgtagatggactcacaggcttcagctggccacctaagctcagggatggaaaaattattgaataatattcttctaggacagtcagctatgggatcctgtaagactagtcctgggaactccttaaataatctggcaacactgacgcccatccggatgtgtatcgtgaaattcaggcattaagatagggcacttccccaagccttattagagactaatctaaagctggcaagtctcccaccacagtaggcacttgagagagttctggcttgaggacctacttccctttgctcttctaaagagagggggaaacaaaaccaataagcagtactcttacctcttactttaactcgaaatttgcaagtgcccttattctcagctctgtcatagactgtgtactggatcttgtggtctccttctggaaagttggagcctggggggaggccttttagaatgacacttagagaaaaaaaatcagaaacaggaaagatgacattatggacctgacaagcaagtgacgatcccctactctttacaggacatggagagactgaggggcaaccattagaccagtttaaataaaacaaaaatttcttgaagaatagaatctcctaagctttagtctgttttagaagagcagtttgtgaccagaaaatggaagacccaaactactgggaagcttagacttttttcttgctgaagggtagaatggtagggaagtgggtagaggggggagggaggatgaaaaatatagggcccaagtctcctccttcaatctcactcttgttccaggggggacctgaattgcctcactgttgggaagacgagggaattttctgtgaggaaaatcattagagaatatagtccaagcagtcactggcaatttgggcctgcggggcgggggtgggtgctagaactttctctgttctttctgtctgggacagtggagacctaaaggcaagttctctgtgattccttggttatcctaataacataataataatgacaaaaagtgttctttgcacttacataaaccttacatgttaggcatggttctaggcattttgcatatatttacttaatcctccttatttaatccaacaaccctataaggtaggtagtattatctctgattcacagatgaggaaactgaggcacaaaaaggctaaagaacttgcccaaggtcacacagctagggtgagtttatcttttttcttggctgcctaatgaggacaccaataagtatagcaggatcaaaatccacgttctgtttttcaatatacatataattccccatctccctacagttctgggaatgatgagaatatttgctaataatgaacacgtggaattatcattgtcaccattgaggaaagccttacatgtaggtgggtgaggtggctgtttaccaggtatgagagaggggtcttgggaaaatgtcagaaatcccactattttgagacatgctgctgttggctttagatgctttaaggtctttagaaagcacagtttaaattcagataaacctgagaggagtgatacttcaaatataagtggatgtaacctttctgagactttgtttcacctgtgacatgcaaataacagaaggagtaaataagggaactcacaagaagcacttgtctcagagcttgacactagaaccttctccctcacaagggagcgatagagcagtagcttggataggaaatggtggaaggggtcataggagaaatgccagggcagcaaggagccctagtgagagcgaaaagggaacaagacagccttctctgaactcctcatcctgttggagtgcattcccaccacatcctgctctaagcctttctggcctctgggttgtagaactctggaagcagacagctgctctgaacaaagggacaggagaatactgagatgctgttttaaaatgtaacaatcctgccgggtgcagtggctcatgaatgtaatcccagcacttttggaggctgaggcaggcagatcacctgaggtcaggagtgcaagaccagcctggccaacatggcaaaaacccatctctactaaaaatacaaaaattagcagggcatggtggtgcacacctgtaatcccagctactcaggagactgagtcaggagaatcacttgaacctgggaggcggaggttgctgtgagccaagatcgtgccactgcactccagcctgggcaacagagtgagaatctgtctcaaaaaataaaaaaatcaaataaaatgtaacactcctaaccatattacgcaagttacccataaaaagaacaaggtgaatattctcacaaagcttgtagacaaatagagtcatctgatggcttgatgttttgtgtttatcacacaggttttttcaacagcagtcagagctgcaaaaatctaaaaacctactacgtgctggggctgggccagacattgtgctagaccctgaagagtcaaaggtaaataaaacccaatccctgataacatcaacttacttttcaattctgattgcctacattttctccaaaggaatttgtgggatgtgtatgtgacagcaaataattttttaatggtcaaactttatctttgagaagttacaatgggagagcataactagtaatactacttaagctagatgaggcactgggggaagattattggaatgtaggaacaaaatgtcctgtctcctctcactagaaactgtactgttattgctaatcattgtgtaaaaatgttttgtcatgcacagcctgggttgataggattctagaaagtcttttcctgctttatggatcaccaggagataagttagaggtatcctttcatctacagatgaaaactcagtggggaactctaatatgcccataaactttaaggcacagatatgaatgtgctaacatgaagtagtggtctccagggaatatgaaggccaaccaaacagttgcaggggtacaggcccaaatgctagattagaacaacacatagctaaccctcacaaagggatccacccatttttaaaagcttcttaacagtgcttctcattgtgattggtaaaacaaacacaccaacaaaaagcaactcagatacatgtcaaactatgaatgaaattggtccaggagaatggggtagaggtggggaagaaagcagaagataccttctctttttttaaataagcatctgtaagtgtttgatatgatcgggagttttaaaaataaattaaaaagctttgaaagagataaatacagccaaaaaacaaggggtgaaaaagttttgcactaaactgtactcacagagcacaagagcggcagcctttggcaccacctgggagacacagatggcttcccagtgcaggtaatggcctgggggcatgagtagggtctgcctgggcaggcaatgggggtggctctattcttaaattaaccaactggcttcctctttccccttctgttcctccttcccttcttctcaccaccccttcttttacattttttttatttttaatttttgtgagtatatggtaggtatatatatttatggggtacatgagatttttttttttaatttttttgagatggcgtctcactctgtcacccaggctggagcacggtggtgcaatcttggctcactgcaacctcagcctcacaggttcaagcgattctcatgcctcagcctcctgagtagctgggattacaggtgtgtgccaccatgcctggctaatttttgtatttttagtagagatggggtttcaccatgttagccaggctggtctcaaacttctgacctcaagtgatccgcctgcctcgtcctcacaaagtgctgggattacaggcatgagccaccgcacccagccaagatgttttgatacaggcatgcaatgcataataatcacatcattcaccaccccttatttctcctttttccttcagtaaggatttactgagtgctaactatgtgccaggcacagttctgggcattaaggacatagcagtgaacatattataatagagacaggcaatcaacaaatacataggtgacatatatagtatgttaggtagtgaccagggggaccacatctgaaagcataaatagaccagcatatatacactcccctactctgggtagtaaacatctcacataaaagagacagcatcattttatctgccaagtttcacttactcagtaagaattccatctgctgtgtctcttccttcgggtgtctcccaggacacccggactgtcagtttgttgggttctgcaatgcgttccttcacacttgggcacttgattctaggaggttccatatctgaaaatataaccaaaacattctcatcatcatcaagaaatatctagtcaaactggggttcaacacccacagtttaaaataccaaagcctctgggtattctccattttcaaagagtttgttcaccctatatattccccttttctcccttcataatgcttttactctcctgctaagttttgaagattgtttaaatactcacatttgcagggctaaacctgcaatcaactggccttgcaaggtgtcctgtgggtaattcattagttacagcctttcctccccatgcttccaaactctgcctaccgaaggccacatggcagttacccagctgaaactagaagtcatttggctttagtgagtacttcctgctttgaacacagcatcatggaatattacagaaaggcattctagctatcatctagtcagattcaattcaaggcaacaaatttttcatgagtaccaatcttatccaaggcttcattccaactgctggggttgggggtgcacaaaggcaagagaatcatgtgctcctgacatttcagagaatttgccatgtattggagggattacattatcacacatgaaatataacatgaggtagaaaatggcaattgccccaggcaaggtaaaagtgaatgctatggaggtgtagaggagccgcccaactctctcattttacagatgtgcaaactgaggctcaaagaacttaaatgatttatttaagaccacacatgtagataatggcactgtgaattacaatctaagtcggagcacttgccactggaacaagctctctctcttcctgctatctattatcaacatattgcttaatatcttaaaataggcaatggtctgtctgggtccactctccccttgaactgctactgaactacacttatggttttatgttctgggacagcagttttactgtggctctggacctccaaaagcctcccaaatttcttcaagtagtttctctacctggtaataggagttctgcctcgatagtgataacaaggatgggtggttaatgagggctcaaagtaaatgagatgtcaactctacactgggttgtatttcatcttatagctgaagtgaaatcacaagaggaagttcacatttctgcaaattctacttaatatttctgaacaggtagagaatgtatttaaagaaggcatagcaaattaaggacattcagcttcatgttactttacatatcaactgataagtattaagtgctattactgccttaatgaaagttaaatgtccttttgattctgaatgacagatgtctttgagagactaaatgcaccaagtaaaattctttatatactttctcctgtgtcttgtctaataatttctcattttattcagggtaagaagttacgaataacttattaaacaattttgccttcagctatccaaattcattttcattctatgtcgtgcttcagtggagtgtgaacttaacagccttaatgcaccaatcctaaattgaataaccaccatattttgttgaatctaagtcactcctaattgtgaaatgcatccctatttcagggatattaaaaggtagaaataatacgcttctcagaattgataaaataaagtatacaaatactatgatgaaatggaagatgctttaaatgcattcaagatgtctatactcagctgttacgtttttaaaaacatttaattttttactatgataggtgatagaagacaaacttttataattcagatgaacatttcacagaaagacaagtatataatgactgccccctgctggtcaaatatagctggcaattacattatagaaagtatatttattagcatacagatttcaatgtaaaattacattgtgttaccatattttcttggtgcagcatggtcagagtgaaaagcaacttagtctctgtcaggtaaactaaatgtctggatgatacattgttgtttgttttctgtatcaagatgtactaacagtgtaagcacacaggctccaagataggttatctgggtgaagagtctcagagtttcccaaagccagcttatctctagctaacaatgatcagctgaactggcctagcttttcagaaacagtgctcttccaaagaagaaacaagaagaaataaatcattacaaataataactaatattggaggactccttcctacatgcccaccccatgctaagtaccctccctatattattttactgaatttgcacaaccacccattagactaagcagtgttattagcatcctcatttatagactgggaagaagcatttcctctcttttggaatttctttgtggtctgggatttttaaatgccattacatattttaaagctattttaataaaccaaacccttttgtgtatctgcctgctgctgacctagtgttttccgccaacctttgcacacatactgttttgtgatggtctgtcatagcttccccatgaacccttgaagagcctctgcaggacttgatcctgacacatcctcaagcagctgccttctctctcggctggtgagacaagctggtctgcccttcagctgatgctccagagacctaagcctgttattacccagacttggccccgatagcattttataagttatacatttccatgaatgaaaggaacaaagttactatagaaacataattactatcccctgttgaattaggatgcctgcaattatataaaaatcttgaaaccttcagtgaaaattctggcctttgctctctgccacattcattggagacatctgacaaactgtctcccttctctgtgctctagttatctctgtgcatataaaatatgagatacaaatatattgcattgtatcaactactatttatctaagaagctgaacttttttttcgagacaggctctcactctgtcacccaggctggagtgcagtggcacaatatcggctcactgcagccttgacttcccagactcatgtgatcctcccacctcagcctcccaagtagctgggactacaggcatgcaccaccatgcctagctgattttatttattcatttatttatttatttttgtagagacaggattttgccatgttgcccaggctggtctcgaactcctgggctcaagaaatctgcctgtcttagcctcccaaagtgctgggattacaggtgtgagccaccagcacccagctgaagctgaactatttacttggaaatccttgacacatctaacccggtaggtagtggaaataaggaagaagctcaaaaggacaaagtcttgcccaacagataacaataaaatgcaagggaagtgaccctgtgccagttccagacctaggccctcaaagaatctggtgccttctgctttcactatgttaaaagccagctgccatctaaagaagtccaattgactggagaggccatgtaatcaggatgagaaattataaatgagagagagagagagaaagagactcagccagaccccagtcagtacaacttttcccaactgaggtaccagacctgtgagtgaagccatcttgaatcctccagctccacttggtcacctcaaccattaccacatacagcagagatgagctgtccccacagagctctgcccaactttccaacccatagaatctttgagcaataacatagttgtttggagccactaagttttgtgtggtctattgtgcagcaacagatcactgatgcaaatataaaatagtttgagtttggtgatagagaaaggaagagttcttttcaagggggcataggaagtgagtgactgccaaatgcagaacaaacctggccattgaaaactcatccagttgtttgcttcccccagccagagcgtaatctctgtggatggctctgggaagtggtttcctctgtttggcaccatacaaaaatccagagaactttccaaaacagacaaaagaggcaagaagggaggcaatgaaatccacatttaaaagtcatgatcatagccgggtgtggtggctcatgcctgtagccccagctactcaggaggctgatgtgggaggatcacttaagcctgggagttcaagaccagcctggacgacatagcaagaggccagcctgggcaacataatgagacctcatctctaaaagtcaacatcttcacaagaaagaagcccaaataaaaattcattggtgatacatttatattagagagagccactaaaagttgacctgttctgtttgtactaacaaatcatgtaagggaaaaagtgaatcagtatctcagtcaatcaagttgttttaactgaaactagcctctgaaagtttgcaaaagaatgtgtatttgtcaacccaggaagaatttagcacaatttaacatcatttgcaacaatgcatggatacattcattcttagccctactgatgtttgcatcaactgaataatgcaatgcagcccagcaataatgcaatgatcccattcctatgggtcattgggtaaaccagctgtgagacagctgggacacaagaaacgtatgccatcaatttccatatattacatctccaaaatgttttattccagaatttcatttgtgttaataaatctccacctattctactctgtagaaaacaaaaaataagtgagcaaaaaataaaatatatttatttaaaaatattttttccttgatagataattagaacttaaatgtgttgtctggtcactttattacaatccgttccacagggcaaaaaggaaagtttgtacattgtcttttgttaaagtaattaaatggatactctctgaatgtcaaaagacctttgctggtttttcattgtccgtggtttttaaagtatctttaatttgttttcttcctgttttggcctaggaagaagtgttggtctaaaggagagatcatgtgtctactcaaaatctggtctttacatgaggacttgttgtgattccaactgttcattgttctatctaaatgccaacataaccaaaaataactaaaaatggaaagaaagaaaaatatcccccgaaaacaatagtggttacattctaaggtttattttcttccagatcaatggaggttgtggctcttcaaagactttttaccctcctgcaatttgcagtattttttttcctcctacattgacttatttttatctatatctgtttctgaaataactatgaatttcagctcattgccagagtatggtctgtgtaagagaattaattttaacttgtggcaccttcaaattagccagaccacagaactgaccacctcagagtccaaagtaagcccagtcttctctcttccctcacagtctagaagagaactgggacaactttctcaccactcagtacagctctggccaagactgttgaaggttgtgtggaaatctgggaactacttagccactatgtgtcacctcctaaaataggttgaagttctgagttacgctcaaggaccccctacccctgtcaacacaaaaacaaatttattaaactattttaatacatttaaagccaaaaaagtaaataatacccctggagtaaaattcactggggacaaacctcagcttgtctgtcgcgaaaatcaaagaaagaattgcctgcttgctttgcccatttctctcttttttcctgggagctctaggctctcttgtggatcgctgtacccctttttgtcatccctaactaattgcatgtacaatcctccttctcccaaatatgcctgaaccttgttctgacaaactgtaatatgaatctcctgaatttggggttcattctctcttcctctgggaaggttccaggcgcatctggtccagcttaagacatgctgttggtttttgagaacaatcagcattttctttccattgttgcacacaatctggaaatttaaacagtatgatccctagagtactctgccaaagcttgcttagcagaaagatttttgagcttctctcctcccaccatcacctctgccccttccaatatgagggagtagattcaattttctttttggtttgttttgaagagctatgcacatagctaatcacagggaggatattgaaagcaacatctgtgaggtgccccctgtgggcagtgttactggcacttagtgaataaaatccaaggatgctgctaaacatcctgcaaacaaaaaaaacagggctccacaacaaagaattatttggccccaaatgtccatcatgctgaggttcagaaactttgccctaaagcatcgtttagcagaatcctaggacccaccgcagacctgctgaatttaaatctgcatttttcccaaggtccctagaggacttcgctgcacagtaaagtttgagaagcagtgccttagatcagtagctctctatttgagtgcctcacaatccctggaatgctcattaaaaaacaaaatgctgtgcctgacccctaaagtttctgactcagcaggtggtgggggtgggttggtaaaaatttgcattcttagaccaggagatgctactgctgcttctgctcccaggaccacaccatgggaaccactcactgcccaacaaacccagagtaaggcaaaatatccaaatcccttccagctgaacaaattgagtgcttgctgaccaccagagtcaatgacaaagaagctacattggggctgaaagacacatagatgttctctactggactgtccctatagtgtcaataactttgctcaggcccccgaactaaaatcagcaggagtatgccacatctctgccagcctgtagttgcctcaatagcaaaccaagaaaaagacaaaagtcagatggaagccatcagctacgaagtcagctccaggatagacactgaggttagatctagggctgagccagagaaccagtgatgctactgagagcaaagttgcatgcttaggccttacaggaggaatagtgatgctccctttacaatccacgatgtgaacaccccctgctcctcccaaagcaagtgcctcctaagggctgtggcattttcttacccacacaggaggctggccggccgctccaggccttgttgtccatacatgtgacggtccgctcccctttcaacgtgtatcctggtgaacaataatactcacaccgggagttaaagtaggcaccatctacacacttaaaccctccatttgctggcatggcaagggtaggacatcgcttttctgaaaatgagaaaatcagatattcagcatttcttagtttttgtctatagagtttcatttcagagtctagaaactctgaaagcatgaggtgaaaagttaatttaaatataagaaggccaggcgcagtggctcactcctgtaatcccagcactttgggaggtcgaggcaggtggatcacctgacttcgggagttcgagaccagcctgaccaacatggagaaaccccatctctactaaaagtacaaaattagccaggcgtggtggcgcatgcctgtaatcccagctactcgggaggctacggcaggaggatcgcttgaacccaggaggcagaggttgcggcgagctgagattgcgccattgcgctccagcctgggcaacaagaacacgactttgtataaataaataaaacaaatggaatttaagaaacaatggatggttttatgtcacacagaagacacaaagtttcctgtcacactggcttgggttggcaacccagctaagccactatcttaggttgagctccccagaagcagattctgagatacggatttatgtgcatgaggtttagtaagaaagtgctcccagggagactagtgagggggtgaggaaagcagaacagggaaggggagaaatccaggcaagatgagatctcaggcaaagtcagcagcagcctgatcccatagggaagctctggagtgtgaatgacagctcattctgtcctgcccccaggcaaggaagctgggctttcataattctttatcagtcagtcattgggcagctacaggctgctcacaggagatgctttctcttgtgaaaagagaacgagagtgagagagtgagagagagagagagcgagtgggatcagtcctctgaaggagcagtcttctgaataaggttgaagttccaagtctttaagagcaaagtactcagaagctgggtactggatacatacaactagtaaaaggcatcgaggagatctgggtagagcagattgtccactacagtcacccagttgcagagtctgcatagtctcgatgacatggctgcagccttgaaacctcagtttccctgacaatgaagttaacataatggcacccatattgatagtgttactgtaaaaatcaaatgtatgtgaaattcttggcaaaccataagcgctcaaaaagtggtggctgttttgaataccaaagacatctaaaatgtgcttcaacaatgctgtaccacttgcaattttccaaatgaggtatgacttgtcatgaagctaaaagccagcccctgaaatgctgctcctctaagcttctcccttgaggcacactcactttcataaataagcatcacttcttctgtgactctttcctgcctccctaagccccactccttgggagaacactttttttttctttttttttaagagatggagtcttgctctgtcacccaggttggagtgcagtggcacaatctcggctcactacaacctccgcctcccgggttctagcaattctcctgcctcagcctcctgagtagctgggattacagatgcacgctgccacacccagctaattttttgtattttagtagagatggggtttcaccgtgttgctcaggctggtgtcgaactcctgagctcaggcaacccacccgcctcggcctcccaaagtgctgggattacaggcatgagccactgcgcccagccaggagaactcttctttaatctgctaccatatgtccctgactttgtacccttcttgtacttatctcccagttgacacctctgccttactaaagcctcttcatggcaggacccatgtgcgtcttatttgtttctaaatccccaacacctcttcaggatccagcactaactgaacaaatgtaactcattttctgaacaatgatcttctctccccttttctcaaacagctgatcatatcattctctctgagaggagccaactcacttccaccatatcttagaatccccctggtgtccccctgatcataaggagaatttttctcatcaatattcagtgaaaatcctcaatctcagagcaaaagaactttggctctggtcatccctgaggacccaacacagagctggcctactcacgtttgcagatgaccttgtcagaccatcgtttgtttgactggcagatcagtagggaagagccatgcagctcgtagcccttctggcagcgaatgtcgcacctggttcccagggctgttttgtagtatcctccttgaggggccctgcagtacacatccccatacttcaccttgatgggggagcaccacggggtatctacaagtagcagaaacaaaagaggagataaatatgaaatgacactttcagaaaatgtgtccccttactcttactgtcccaggctggctacattccaaattttggaccttcaattagtgccccatgttttcttaggtgtctccgggtagggaggttatgatcatgggactaagtgtcagatatatctgaacatgaatctgagttcctctataactgactgtgtgatcttagacaagttagctaacctctctgagtcaatatctatacttatgccatagtgctgttacaaggacgaaataaaaattgcatatcaagcatctagcacagtacctagcatatatgttcaataaatgcttgttctttttagtatttcccttaactagatacataagattttttatttttattttttagataattctttcaagggcaactgatgtcatacatagcggtagggattcaataattggttaatttggatttcgtctgagccgtatgcacattctctctaaaatgttgtaatactggcattaatctaaatgatgctacaatttccaggtgtttgtaacaagatataaatttcgcttaaagtcacagaacaattgctctccatagagaagtgtccccagttatgccccatttacgtaacagggtgacaccctccccagatggcaaagttgcaggtgttttgattttggtctcatagttgcccaaagcacagctgggatgaaatgaataaatcagaacctccctgctgtgcttttgaaatgttctctttgagatccataaaatataagggcaacactagctccttggtggataagttcctacagcagccactgccccattgtcccacaattgatggggaacagtgaggagttccctaaagcctgccgggctctcaatgccatgaataggagccacttccctgcaactgcctggctcatcactccaacccagcacctgagctgtcagtgagtgaggtaagaccgccatcatgtggccaggaaggaggacagaccctgttttactttcccaggaattctcttctgaggatatgcctccaactgcttctcagttacaaaaaccaacagttctggccacgtcttatgcatagaccactgttttagttttgccttcacatttccttcagctaatactttctcttttttttttcttttttagaaacagggtctcactctgtcacccaggctggagtgtagtggcatgatcattgctcactgcagtctcggcctcctaggctcaagtgatcctcctgtctcagcttcccaagtagctggaactacaggcacgcaccaccgtccctggtctggctaatactttcgtcatatcatgttttgcagacagctgcaagtgagccctaaactcaagactcaagtaatcttccctggactttctaggtaaaggtgatgtcctaaaggcttaacctagagctgattaaatttaaccatgtggatataaacgtgtaggagctcacacaaggcctaaagaacttccttgaataaattttccttcctctaagggttttaatataatctgtatgtactacatatatttgtgatatacagtactccccctttgcccacgggggatattggatgcctgaagccttggatagtacctaacgctatatatactgtttgtttcttacacaaacatacctatgatgaagtttaatttataaattaggcatgataaaagattaacaacaactaataataatatagaacaattataacaatatactgtaatgaaagttaggtgaatgtactgtctctctctcaaaatatctaatattttggggctgcggttgactgaaggtaaatggaaccttggaaagtgaaaccgcagataagggggaactaatgtatgtatatatatgacctgcatactcatacatcacaaactcactcaattaatatgaatatatgatggtattccaagcaaaagaatcaaaagccatgcttgccacataccaggagcaccgtaaatgttggttacatttaattttctttcttattttactttaattcaaaaacacttactctgtgctggacattgtgcaggggcctcaggatctaaaactaaaccctcacttaataatggcttgtctctagcttttaaaattaaaaaaacttggccaggtgcagtggctcacgcctgtaatcccagcactttgggaggccaaggtgggtggatcacctgaggttaggagttcgagaccagcctggccaacatagtgaaacccctgtctgtactaaaaatgcaacattagctgggtgtggtggcgtgtgcctgtagtcccagctacctgggaggctaagataggagaatcgcttgaacctgggaggcggatgttacagtgagccaagatcacgccactgcactacagcctgggtgacagggtgagactccatctcaaaaaataataataaaaataaataaaacttaaattttattgtatgaagcgcacaacatgatgctttgatatacttatacatactgaaatgattgctaccagtaagcaatttaactgacaatagaaacaatgccctaagaaaatttattcttaaacattcagggtaagttctagggcaagcacacattttggccatctggtctacctgtcacatttgcaatgctgtgaggtgaagatggatgtgaagaacaaggacctgagggcactaggcaacccctgctgtagatgtgaagggtcatctgtgcatgcatgtgttttaggaagatttttcaacaagggactcaaagaaaaaaaaatctaaacccataaatagttaagaagttttgcgaattagaacctttccttaccccaagcatctgattaacgtatttgtgctttgcttgattggttaattcctgaggctatggagatagaaactataggtaggaatgagtatttgcattcagatctcacaaaaaaatgtggtatgtgatgggaagcacacctgcacataagcaccaggcaccagtcattatattggaaatattgttcacttgtgtagaaaacaactgaaggacatctccagtcaaaagttgtccagtcctaccctgattctcctgtatctgagacacatcacaacaaacaagggccatgtcctcatcccaggaattaggacaaatttccagggcaaaatgccgcagtgaaactttgttaaccatttttttttttttttcaaattcttcctccactgtaagaggaactagattcagagagaaagcatctctaaatttaccttcatttctcccaggtttccctaagcttcagagaaatgtttcaccagtagaaatatttgtggacatacttacctgagtctggacagaaggttcttgtttaggctttttatacgtgctggggagtggattgctgggaatatgtagagatggagttctttatcattaagtttcatttgagcaacatactttaacataccgtttcagaagccatgctgggctcagaaagagcacgatgaaatgagcttatgaaaatcaagttttctccttccccattcatcttagtacattatcagcacttggtccagatttgaccttaggtggtttactctggatgattctggctgtaatgtatgaattaggcttgattttcactttcatcagctacagctgcctttgcagaagtgaggacagtaaagaaacttatgagaataaaatgaccattgggatgctgaaagacagcatttcagagatttccaatgcattttgctttatttccttttttaaaaaagggagtatatatatatatttttttttccttgatagataattagaacttaaatgtgttgtctggtcactttattacaatctgtttcacaaggcaaaaaggaaagttctcctggcaccagcaggtcctcattagcacataagcaaagcattcacctttatatctagggtgtgaatacccgacttcatcgtcttctagtggtgagtctcccgatcctacaataaaaaagaacagaaactgcagcaagaaaagccacatagtatggacgcatatttcaaagcattcctttgccacagaccatgcaggaggtgctattagaatgcagagccaagagcaaaagcttctgtggccattcatgaaggaacaaacaggagatctctcagagtgaaaccggctgagctgagattgccaaaaaccaagcaaaatgagcctcaaactgttttggaatcaccatatgccaagtgaaattctggaatagggaaacagagagagtcaacttcactctgagaagatgccaatgtatatgaatctcatgccaggggagatgcaataaaatgtgtgcatcagacacagtccacagtttccccagcagtcaaagaaaacccagtagaactgggtgtttatggtacctgaaaacaggtccatcttgtgaaataaatttaaatgcaagataaggaggtaaatcaaatgtcttatcttgacaaaagaaacacaaagttgcttctatatacagcatttgtaggaaatgaaggctgaaatagactatctgtgtgcttatttagaacctctcatgaacgtatggctcaagtaaaatttctttttttttttttttttttgagacggagtctcactctgttgctaggctggagtgcaatggtgtgattttggctcaccgcaacctccgcctcttgggttcaagggattctcctgcctcggcctcctgaatagctggaattacaggcatgtgccaccatgcctggctaattttgtatttttagtagagacgggatttctccatgttggtcaggctggtcgcgaactcccgacctcagatgatctgcccgcctcggcctcacaaagtgctgggattacaggcgtgagccaccgtgcccagccagtaaaatttcttaatgagcgttgctaccaataaaaaccacggcctcagagagaacgtctgtgtattattttaatttaactcatttgcaagctggagctgaatggtttttaaaatattaaatattgaattccagtgagcagtaaatccttaatccttgaagtggtagcagatgccaaacttcaaaactgtaatcttaaattcagagaacttccctccagacttcacagtctaattaatgactcgagttagctctgtcttggtcacgcatttagttgtagttacttgccaccataacagacaagaacatcctccactgtgaggttattcaaatccccatgcagctaatgagtaatggtccctgttccacttgtgttctggatgagagatgtagagtgtggaaactgaaagtggagaggagatgagggctggactgtgttcattaggaaaagacccgcaactacagaagcccaattctgtattttcctttgctgcagatttcctcaccttgtctctgcacacccagatgtgtacaaaattacaaactattcatcattgcatataaaaaaatgagcactggaaccagacacagtggctcatgcctgtaatctcagaaactagggaggctgagtgggagaattacttgagcccaggagttcaaaaaacagcctggataacatagtgagaacccatctcaaaaacaaaacaaaacaaaaaacaatgaaaaccaggaaacctacctaacaacatgaatcaaaggcctatgctcaaaccctttgatcaagtcattccacttctaggaatctacccaaggaaacagttgaactgcatgtctgcatgtgaaccttcaatcatccaaattaaaaaaaaatccagatacatgagcagcaagctttctccccccgcccagccctccaacacacatatacacacatacatatattttgccctcggttgtcatcctggttaacttgtctacagtatttacagcatttagtatgaatgactacccattcatttcatgaagctctcttctgcagtggcttccaaatgacaacagtttcccgattttcttcctcctttctaaacagactctctggacagcacatctagatcagcctgccatttggacataagtatttcccaggagtccagtattggtcctttacatatctccagactattttcctgggccatctcactcccatacttgcctcaaaccattccccatgtactgatgataaatccattgtttctagccttgaactgtctcctaagagccaagctagaatcttcaactgttgtctggatatctccacactcacactcaacctgctcaaaaccagattccttttcttatcaccaaatttgtgcatcccccagtgtttcccatttcagcaaataaccatcttccagctactctgccacatggaaaatctcagcctttttttcttctatcttcttcatctaccacattctaagataggaattaacttaaatatccaactacaagaaatggtcaatcatattatgatccattcataacataataatgttcattttgaagaggtttcttaacatgggaaaatattatagaatgctgaatgaataaagaaagaagcataacccccaaaatgcaaaaatgcattaagattttaaaatatggcaaagctcatgtgtgagaacaacaatatggatgaataaaactaaaataatattgtgagcaaagttggtcccagaagactatatactatatatacgactccttttttataaagttcaaaaacttctaacactaaattgttgggaaatacaaagatatgtacggtaatttttaacaaagcaaggagacctcttaccctttcctaatcttctcttcttgaacaactgagttctaaggcctttagagcaaggcagacatctgtaccagaaaggacagggaggcatggtaggccagagcaggatgtcagagcccaaacagggcatagagggaaaacaggggcaaagagagaatgcacatgggcagatagcccagcaggggaatcacagattagtaagataaggagggctttcacatgggtaaggcggaagaaagcctggcattgggttgaaaagtacagtttctagattcccttatccctaggttgtgaaagggtctacttttagtgatttggaaggaatcaaagggaaggaactcttttctacagttgtgcatgcagaaaataggctacagcagatgtgagtgttgtcaactgtgtccactgtcccctcatcagctttgtgtggtagggaggatagtgacgttggcagtggtgataatcacggcagcaacagtttcctagcctgagtgataggaggagtttctggcatctggactgaagtcatggtgccatttgacctttaatgcagacttcttgacttccattgctccagcccttccaattttgtgagtaccttatttcctgcattaaatcattttttgcataaaatacctagagaggattctgtttcctatattaaacctaacagatatttaagcaaaccaattaagaaatgaatatatggttttatagctttctcttagtaactggacactaccctaacacagggcacactgctttctacccacaagtcttttgtagataagagaggggacttttatgtgaacatagatgagtaaggaggaaaaaagaaaaaaaaaacctactggagtcaaacttactctttttccgaattggtctatctgctaagctaaatgcaatctgatttctgtgcaattgaattcacatgggaaaggaaataacacacactaagtgcctatgatatgtgtactatgctaggcaatttctatgcactatctcattaaatctatacaataacactggccatttggtactattttagatttatcattagggaaaccaagtctctaacgtctttacttgtccaaggttatgcagccagtaaatggtaaatcagggattcgaatcctgtctgcctggccttcaaatctatcattcttttttcactaggccttactgccttctgcgcctacaatttcaaagaaatgagatagctggctttgggatcactgataggcaaacagcaaatggcttcttcagtagtgtgagaacaaatatgccaagagtgggtcccacagaagcaaaatgaagaatccatgtgtagcagaagctgctggttgcctgtccagcagccattctccccttccttcttactaaaagatcacaggttgtgttcagcagcaatgtgtccctccccaaacgatgaaccatgatgactcttaagtcaaaaaattaattcccctttgccaggaattgctccagggataagcatgtaacccaatattggacaatggcaagtaaaatgaagtctgcttaggggcagggggagggagcttatgggaaagatttttctccctgataaaagagaaaactgcgcaaggagaagacttttccctcttttctgcctttcagctttggaggctattgtgtaaggataaacgtctgaagctggagcagccattttgcaaccacaaggtaagatgtcacaggactaaagattttcagttgaggatggcaaagtggatagataaaaagaacccaggaccttggatgatgtcaccagactacaacatcaaccttatacatcttacctccacaattcttgttaggtcaacaataaatatcctttcaatttaagccactgtgaatagcactgtttgttacatgcaactgtatgcatataaactgatacacaaatgaatgaaaactttactgcatattcttgatagattttttttttttttttgagacagggtctcgctctgttgcccaggagggagtgtagtggtatgatcccggcttactgcagcctccatctcctgggtccaagagattctcgtgcctcagcctactgagtagctgggattacaagcatgcaccactacgctcagctaatttttgtatttttactagagacagggtttcaccatgttggccaggctggtctcgaactagtgacctcaagtgatctgcccgcctgggcctcccaaagtgctgggattacaggcatgagccactgccctcagccttgataggtgttttttaagtgaaaagaaaataaatgggtattagctgccactctcagaaaatttccagtttattttcagcctgagctcatatattaacttctataaaaatatgatgactagtctgcaaaatagacaccctgaaagatacaataagctcgaagacagactcacttatgttcagtagactgtacttactaaagcagcagaggagctttatgtacattggggaaagattttccccaccattaaaatttttcaaaaggaagaaaaatagagaaagaagttggggaggatgggagaagggaggtttcttagtaaactttcctttatttataaaaggctatccctctagaattctgctaattgaggttttattatgacataactattaatcagtctacatatggttcagattaccactctggaaagaatgcttcagtgcttcttccacacaaatacaaattgtacgttggctcagaaatcagaaactcagagccatgtaggattctgtctctcagccatacctggagccaactgcatttataattttgctctccttgcaaaaactttctctaattcaacagattttcaaagaaatagccactctttttttttccaaagttcaaattagggtcttcctggcctatggaaccccacccattcattctgaatgtccaggtagataagatcatcgaggcaccaaagtcactcttaaataatacttattatatgtattgaaattacatcaggagactagatttctgaaggctagtagagtgttcctgctatcacgccataaggtttctcaccgtaaggtagggatgtggtagagatttaagactaatggaaaacttggcaaatttgctaaaactacatagttctttattgattatgatacctgacccaaattggtagatttgctggctctgtattatatttttagctcaaagtgttgggtttattttttagtcattttgaagacagttcttcattctttacattttgtttctcccttcatcattattctagacataattttaatattgtcagaaagaagcatatttaatagtaaattgcaccatcaattttatactgaaagtcaatgggaaaataaaatttactttgcagtagggattcttaacctgaggatcatggcctactacagaattaatgaaagggctttggagggcccatgaaccccttgtaattgaacatgttttttggtacatgcttttgatacatgccttttggtactagcatgctttttctaggggaaaaagatgttagctttcagtagattttaataaattttaaaagccatggtcttacagcattctttattgttaagcatgttagaatatttactgaagaagcatgtagtgtccttctttttgatatttaactcattttagtgttggggagagagaagcaaatatgtttttaaaaaggataaatgcttatcatactggtttcttctagattagtgctgtccaatgcaactttctgcaatgatggaaatattctttatctgtactgtcaaatacggcagccactagtcctatgtggttattaagcatttaaaatgtggctagtaaaacaagagaagtgaatgtttttatttcatttaattttagttaatttaaatttacatttaaatagccacatgtggttaatagctaccatactggatagcacaggcctagacctaactttttaaaagtattctatggagataaatcatgtctataaattgctcaggggtgggaactatgtctaatttaccttgtatacccagtatatgatttggaattggtaaaaatgttggagaaaaaagagaaaaatctgccttaaatttcttgtgacacataaattatgtcctcatgcttataattttggatggttttattctaatcagtccagcttccgtatataaatttaaactgtgacaatactgcagatttggatgtttacaaaagggtattttgtactattggaagccatagggtgtttatttgtgggagccagatgatttagtgctaacaaatgatctgccaatggattacagagcagctgtggtacagtatgaaggacatttgaatagcttctgaacaaagatcaaatccaaggcattgccagaaaaacatgatttaaagatgaaggcaaaattacggctgtaaaatcctttgttaaatcaaggtagtgccttaaagtaccttcagtcttacaaaaggccccttagagagattaagggtatctcaagttcctctcaatcaaacagagaagagtctatatctatgagatttgtaaggtggctaatagggtgaacttttgtctaatagagtgaattctaagaagattcacaggagacccacaaaattcttaaaagagttatatatgctgaaatatcactagcttgacttaggaaggcagagacattaaggaataaggagaggtctttgatcccctacaattatactgtcagaaagcaggctcagtgagctgcttagctgtgaatagatgctatttttctaaaaaaaaaaaaaaggggggggggagtgagtatattttgcatgttggtgggaaataatcactgggtgccagagggtagactctgatatgcagcttctaagatggcccccaattatccctgtcccctggcattcataaccttttgtaactcctcactttaagtgtggaatgaatttattaacttgcttctaatgaataaattttggcagaagggacaccatatctcttttgaagtcaagttataaaaagactgtggtgtccatcttgaatactgtctcacactctctctcttggatcactcattccgggtcaagttagctgccaagtcatgagggcgccctgtggagtggcccatgtgttgagggaccaaaagcctgccaacaataacataagtaaggttataagaagatctccccagctacacacacacataacacccacaagtcgagccatcagatgaaactgcaggccaagccaataacttgcttgcaacctcatgagagaccttgagccagctaaaccatgcccagatcctgacttataaaaattctaacataataaacagtatttgtttttaaaacaaaaggaggaaaaggtgtaggaagagtagaaagtacaaaaggaggaagggaaaaagaaagggcatttgccttaaagtcagaagattctgatgtacctctcagccttggtttaatagtcttctcttaggtcactgcggtagatactgcttattcctcaatcagatcccctttactcaggctggtgtgcccatctcctagctgctgggagcctttgactgcaaataactcacagttgccctcttctccagagaattgtcctcagctgataggagccacttcttcctccccacctgtttcctggaggcagccaatgtttgattgatatggaggaacatgaagccagacttctagcccccaaaggtgagtggaaggacaaccttgcagtatttatgtttctaagaaccctgtggtgctagaatttacctgagactctatccttgcttagctctttcttgcttcccttcctcaattataggtttttttcctgagagtattccctcaacaaaccataagctttgcttctaggaaaccaagctaagagagccactgagtctctctaagcctcaaataccccaattaggcatgcctcaacagggttgccataaattaaatggcataatatatatgttttagttttacaagtttctaatttgagggttcataatcacattttctacttaattatgtgagtataaattgaaggcctccacatccctgagctgctgtgtaaatgagtttcttgaaaaaatgtaaaaatatgacaaacttatatctggcatgatatactttttaaagtttaagcatgaaacatggtcaagaatctcagtgcttccaaagttttctgtgtgttttttaaaattcctctaacaatcctgtatgatttgtgatttagaaaatctttcataaacatatgtatatgtattcatcttaataaccaccaggaaaagccatacagtcaatctttttcagaaaagtaaactgttgtcaagtttactctatgagttcagatgatccagataataaaatttgctttaggaaaaagtgatttttaggctcaagacattaccatagtttacactttgaggtaggaaaaaccctgtggttccctatatgcctttatgacttaaaaacatttacaaaatggggactcaccaaaagttattttattgctgaaaggtgctattgccgggtctcttgtattcttgaagctcttgttaacacaggtgagtgtacaaacatttctagtgacagaaatgggctaacaaagggcctgtccatagcttgtgtggacacaggtacagtggtaacccttctctcctccatagctaaatctgcagaagcttctcttctggaaagtcctaatttatgggggcttttgaagaagcccagaagtcagttccgtatgcctgactagcaggcaagatctattctgttatatcttggcaaagtttcaacagaggagagatgtccaggagttgtgtgtaaaggtgtatatgtttgaaggagtagagcgaaaaagaaactttagcttttcagagcaccagcttcaaccccaagatgaaggctcagaacaagtacacagagaaccaggatctgtaaatgagacattcttccttggattccttacatccctaaataagtggcagactaatagataaaagcgcaagagtaagaaaagaggggaaatacacagaggaagattcttgttccaaatggaacaaagggatccagaaagattagtctaaaccttttgctaatcatggggaatgaactgaagaaaatgtttattaccagtgcttttcttgtggcagaagattcaacagaatgttcagatgaaacaagtttataggacatatcagacattcagcttaccaaatccctgtctttactaccatcataagtgcctcagcgataccaaccatcaactaagaatagtatgtttcaaactgttgaccccatttagtaggtcatgactagtatttttgtagtgaaatagaattgaaaatgtcagggtgcactgcacatataaagaataaaccttactttgtacaatttttgtttttatataggtgtatgtgtggtagggtatccccagtttgcatagcacagtcccattttatgcctgttgtcccagcattactttttcagctttactggggtataatgggcaaaattatatatatttaaggtttacaacatgatgttttgaaatacgtatccattgtgatataatcaccataatcaagctaattaacatatccatcacctcacatggttaccatctaacattattattaatagcattctctttcacactcaaaaccttcctgatttgtacaataaataatatattcactctaacaataggtcacagtagaatatatttcttcctgtgggtcttgtcaaaagtattagaaaaacagtgatttaaatactttgaaaacctacatttgttaagttaattcggtttcctccctcagaatgaaggaatctgaaaatctgagaaagcctttgggggatcggtggtagaagtctacttttatctgatttgttcagggcatagatgttatatcccatgaaacagcaagcagacactgagtttcctcaactgctcatggccatcctctctggtaggatgcaactgaaaaagccctgggattaagttccagtgccatcctgatttgggaagccacttttctttcctgagcctcagtttgctcatctgtaaaatgggacaccagaagtgtttagaagggcatagtacctgttttcaaattatgttaccctagaacactcccatcctcaacctctagctgggacaacagcagtcaagcaaatcaaattgccctcctccttctacacctggcaataaacaaattaccatggcacatcattttaaaaatctgcctggtctttcatttccattgcctctttaagtcctcagtgcaaccttatgaggcaggtatcattcagtgactagaatgtaaacctggggagggcaacaactctttgacactttgtttatgattgtattctcagctcagagaatgaagtgattatcagttataggagaacaaggattgaacttttctgattctaaatctcatgcaatttcactccttgtttctgtcttcatgactcagaaacctacctgaaagccctttccctcctctcagttcctttcttgtgtttaaagctatttcaaagcctagctcccccagtttatctttcctaaccattccattcacattgatgcactctgttcacatttttaaatcagcactgattttatgttgcgttggattttcagaagccatttcgagttttttcttcccagctagacatcaaactcttcagggaatacggtcagggtttgtttccccttactgcccctgtgaaactaacaaaggctctcaaaagttttcttccccttgagactttagcctacacattactgatatgctcaagctgttccatcaatatcagaatgagacatccatctccctcagtgaaggctgtacttacagaaacagatactgtatttaaggcacaaaaagctgcccaaataaagctgcgactggtacgtcgttcttggcagtaacccagcagtataacttacaaaattctggcacatcttggcaaaactgagaataactgaattcagagaagacagagtctaagaaaataaaataaaatcgccacagtgtgtactgagaattgtaggcagcaaacttttaattgccagctgtagattgatattttaatatagtacattaaatggcagagagagacagagagaagagagtgtgaagaaagatatttccagaaaacagcactgaaacactgaaatgaacatcatgagaatgcctgaaagtgacaggctgcagtctgctcagctgaaacctaaggcttcttccttataaaacattctccggttccccaacagggaatagaacacgagcacccaagaacaaaaacctggactttacttgaagttttttacagatggctattttatccagctctgcctgtgttgggaggtagaatcatttcttttctgggtagcttctctcttgaaagcaccgatttctccattcggtgcccttgaactgatagtcacacagtagctgttgtcagttattattatcttcactgggagactcaagctctagtgggaaagtgaaggtgcaactaagctgacggcaattctagttttcaaaatgatcatctgcaggcttttggcaatacctgttgtgtgaggctacaccccagcacacaatgcctggtgctagcacttcctaggtgtgatagacatctattgtgttcctctcaaagaaagaagagcctttcttttggaaaactgcattattcctcatacctatgtggttctagtagaggtgagtttatcctatcccttgactacaggagcaatcatatgaaccaattacatgaaccaatgagaatcttggaaggatttttctctggtggtaaaatgaggaagatgtgagccctgaagctgccaacgacaaagattaaatctcatacagaatgctaattcgagagaatgaagccatcaaagaaaagcaaaaacaaaacagagaaagagagaaagagagatcccacaatatttgagcccttggttccagtattgcttggccccacaagcatacctctgccctaacataagatgataagcccatcctttcttcaaagctttttcgaaactggtttctgtcatgtgccatcaagagtcctaacttaaacagtagaccatcaatttacatttgaatgaaatagatgactaaaacatacagcatgacatctggtttgagataagaaatcaatctcagtgtatcatttccaattccctatttcaaaacaatactatagctcagacttaacactttaaaattaaattaaaacattagtgagccattccataaatttagtgggaccagctttatttgcaataaaatacattagattagaataggggaaaatagcagatacttataatataccatacatagtaaaagtgagcattgtttcatgacacttttgtttcaattatacacagacacacacacacacacacacacacatataccatattttattgactctaaaacaacactttttaacattttaatttccctgaacccaagatgagctctataatcaatggaatggcatagtttaattggtatcatttttcttttttagtgatacctaaaataatggtgactgacgactgacagagttttggagttgatggcatactgtgtgcatggtatgtgtgtgttttggattgtgatataaaacatatttcttactgcaggtagcaatcaaaagagtttgaaaacaattgtattacacaccttatctagaactcccaagttgataatcagaatagtctttgctgtacatatcagctaagtcatttatccactctcatatttacataatgccttaacacactagttttttacagggttccccaaatggctttcttctcattgtggaaacttcctgatcctcatggggaaacctcaggcagcagaacaggcaagtggagataatatgttgcatggataggcttctggtgctatccaacgaataccacatttagcccactgcccagctaaagagagccccacaaagaggcacagcgtggcttgtaaccctgccaaagtatcagggcactgatgacaggggagtcatgtggcctctcacctacagatggcagcatccccaaagtgcatttataaatcagttgcttataatttgaaattggcttttccttggaaaccacattatcagtggtgatcaggtcccctagagagtccataagagctgttttaagccataatatagtcaaactctagatgtccctggggggatggctcagggtccactaaatggggaggccattctcgtccctctcatgcccgctgtcccctgccctgaaacacagcattcaggttcattctacttcctgtacaatcatcctgctacttttcagtctcgagctgctgacccagacagagtttaacaaagaggctaatatggatatggatatttatatgtgtgtcctgttttctgttattgagagtgctgtgatccaagattttgaagctcagaaattccagatgcaaacacaaattaccattttatttcttggctgctcttaaggatgctgcaacttgtcaatacaggagcctgcaggcatgttggccccttcccagtcccttgctggagaagggcctgcagtgacaggctccctttgtccttcccctaggaccaaggcaggctgtctgcagggaagggactggaggggctggtgaagtcctcatttgcagcgatgagggcagttctcagaaaccatgggccagtgaaaaaggcagtatgtgccctaaagggaactttgccaaaaattgagtctttctgagcaattttccagcatcctggtgtgcagatgaaagtccagggtaagaaggaaataaaaggtaaattaaatgaagtagcaactatttctccagccttttaccatgcaggagcagctttgtacagcaccatcttatctggtcttactggccaaggtagacaccagtgagtcctaacacagtccttacagtcctagcttgtaagagagaagaaatacctactatttagttaacagacactacctcaggcactgccttgggtgatttacatgaattatttaattcaatcaaggtactcacatgaattcacatgaaacctatccaaaaaagaaaggtggggagggggggaaatgcaaacacactattttgcagccctaacaaaacctgtcagtaattgttttgttagtatgggtcttttaatgttcttctatgtgtagtagtcaagtcacattcaaattttacacagcacaatcaaactgggtatgggatcttcatcattgttaaggctgcattagggaagttaagacagggcatttttagagcatgaatgccaatgcttcctagaaattcccctcttcaatgaaattctgagcaaggaattataaatgaaaaattaaagcaggcagcaaatgggaaacaccctaggcagtctttttctctcctcccttgatgaacacccaaaaattttcctcaaatgcttgcaaatggcaactttttgtctcattgtaaaatcttgaacaagtggtaggtcagccatctccactgagaattttctagtttgtaaatctgaagaggataatttgaggaggtacatatgtccttcaaacatcaaattacagattgctctggcacaatatcatgaaatacatttgaaagtaactaaaggttgaaaatggaatcaatttcaaagtcaagcaattaggatcctatttcaggcagtatggtgagccatgtagcctggctgtgcttacatgaaaatcaatgaaaaaaatccacttttagcttgcaagaaagtaagaaatactgtgaaagcaggatcctgattaggtaccagatattaaggctcaccttttattctgaggataactgccaaaactgagctttaatttccatggactggtgagaccttggatacagaagacaaactccagagactattcaaggtcatcagttttagaggagactgcctacatcccctcaccctcacctcctacataaagctgatataccaacagcctatactctcagtgtaaagagtgaaataaatccatcccatgtatagggactacaaagaaaagttctcatcttgtaccccagcagtgagtgaaagaaggaaaatccttcccctgagaattaataaccatattattattactattatattattactaaaataccactaacaataattaaaaccacagtcataccatttctgacccattagtttggaagaactctaaaaatataacaagatcaagtgttaacaaggatgttgagcaatggaaatacacattggtgctagaagtttagattggtataacttccttagtaaataatttggcattattgaacaaagtcaaagatatgtatgcatattatccagcaattcaactcctaggtacttagtctagagaaattcctgcacattgttcaagggagatagacaagaatcttcccaatagcactgtttacaagaacataaaactagcaacaacccaaaatgcacatcaagagtagcatggataaatgatggcatatttacacaatgggatcttacaagataacgtgaatgaaaaaatcacaactgcatgtaacaacatgagcaactcttaagaatctaatgttaagtgaagaaaagcaagcaagttatagaagactatattcagcatgtgtccatttatacacaagtcaaaagcatgcaaatgtaaataatgttttttgtttgtttgtttttggtttttttttttttttttttttttttttgagatacagtcttgctctgtcacccaggctggagtgcagtggcgcgatcttggctcactgcaacatccacttcctcggttcaagcaattctcctgcctcagcctcccaagtagctaggattacaggcacgtgccaccacgcccagctaatttttgtatttttagtagagatggagtttcaccatgttgaccaggctgttcttgaactcctgacttcaggtgatctgcctgcctcggcctcccaaagtgctggggttacaggcatgagccactttacccggctgtaaataatgtatttttagagatataaacatattctataaagaaaataataggaatgataaatacaaaatttaggacattggttacctctgaggagatagcgaaaggaaaagaatccaaaggaaagaatagcaaggactacagggtaaagtttttgctctttttttggtaagttcttattaaactggctggtaagtagaggtgtttgtggtttttttttttttttttttaccatacccatattatgtaaatattctttttttctactcattgtttaatttaaaatttttcaagcagagcaattaaaatatctttgatgcaaagagcttgttaggtttgtttctcatttgtttgcaatgataagaacatgtttatccaagaagttcttaaaaattaccatttgggcctccaactaaaagatatgctttgccaataaaattagagagtcttagatctggaaatactcttggaagacaatctgatgcacacgccagcctcaagtactgagagagtcccaatgaaaactcaaaagtttggagacagccttcccagcctactcccaagctgttctcaacattttacttgtaggaaagttgaaatttcttccttaaagtccacctaaatatctttcttgctttaatattatatatggggaaaagccacagattaggaagaagggctcaagagtaacgagatcccagctggcaattttacctgagctcaaatttccagatccaaggaaactacatcccagggccttaaagaatataaaggatggacgtgaaattattcttcataatcactgaaaaattaagggaaaccaaagaagtgtcaaaggctgtggatagacaattttcaaatcagtaaaaatatggagtatggaaaccatagacatgaaaagtttcaattttatcctaagcgttattttagaacagattattaacaaaaaaaataggaagaaatttttagaatagtgacaatttggaatcagcgttggttcaaaaatagcaaatcaggccaaagtaacctcatttctttggtttacccaagagaatgcctcctctagtaaatctagtttacataaaggtccattcagagaaatactgatttatgaattgtattcacagaaagcaattacttttcacttttttgaatacaatccacagaaaatgtttcatcttgtgactcagtacacacatacatttatatgatcgaaaaataagtttcatggaacaatatttaagtatgatgccctctcatatttgctattctattacatttgagtgtttaaaaagtgctaatcatgaccactacaagaatttcacaacccattaacaggtaacctcctctcaggagatatgctatagggctctgtgtcattctaccagtgaaggaagaattaagaagaacaaatctgtagaagataaccaagctggggaggacaagctcttagttttctttctcccaaagcagagtctgaaacaaggacttgggtgctgttgttcatttggaaggtgatcccaggaagcacagtgagaaagcaggggaaatgagaaaggaataggggaaaagcccataaagatatgctaatgagcaggttacttctgggggcaacctggattcattcccactgaggagcctctgaggaaacacaacccagggacacgaaaggttgggtatttacccacagactcctgccttttttttggctaagagctggcggggtgttacatctcctactcttccagaaattcttgctgagcgagctcccacaggactggagtaaatctaaaggcaaagcctctaagacatgtggacatctaaggtgagaaactgtcagcatgtttgagaactgtctacctcagctgcagatgaatccagagatgggcggaggggagatggcacagggcatcaacaatgttggctacagatgggcaaaaccaacagatgatgaaaccataggccatagctagtttgaaacctacaaggagaaattaaatagagattataaacatgaagtcttgtatttctctccctacactaagctgtacacccagcaagggggagagcttccctggcaggcttgggaaagagcagccagctagttgcccacattgtgagccagcaggtgaaatagtttcttaaaaaagagagagcaacagtggcctgcaagaggacagaggctaaaccaaagaagtctggcttatcctagactgaagcaaccacactggaataacagaccatttgggccaattctttttttttcctttcttttttttggacatgttataattgtacatatttatggaatacagagtgatattttgatatatgcatacaatgcataatgattaaattggggtaatttacatatctatcacctcaaatatttatcacttggggccacactttgagaaggacacagacatgccagaagatgctagaaagaaaaaacaaaaaatgaccaacagagactagctttcatagcaaataaataagtaaacaaataaataaaaagtttgttgaatggtgaataaactttagatttgtagcctgaagaaaatgggactaaaaggaaatagaatccctgtgttctgatttctcaatggtcatcccatggataaaaatagagagaaacttactttgtgcagtaccaaaagtgagaaataaggacaatggctagatgtcatgtagagctgattttagcccagtgtgaggcagggtattctaagactccaagaccatcttgagattccatcaaagcttactgaagctggaagtgttcccatgaggccgaaggatgctggcaagaggggtgagatgagggaagtagggtggggctctacagccctttccaaggttaagattatatgattctgtgaaattgtagtaccaaataatgtcttgcacacatactcaggatcaacttttacgctatgaaaaagcaacctttggggagggagtggtgtacagaaaggtggaggacaggacgaaataagactctaaaggtaagagagagaaataataaaaaggcagagtgatgaatgctcacaaaagatcatttccttagctctggagaggagaaaaggatctacggctttcaatccactaccaatcacaaacttaggtttctgccttttcccctgctgtaaaagaaatgtggggagggagaagagagaagcctcagagaataccaatttcatgtgtctcagattcaattcaaagaaagaaaaacaggaggtttcactgctgtcatttagaaaataagctacaggctatttatcacacatattgttggagccttggagcacagaaaatgataaatgatgaatccagatatgccctggcttattaggaacactcacagtgactatcaaacaagcaagcaccctggggtgggggctaagatcactgcatgattaccgctatgattctgggctgtagcaaatgcttcttttgaagtaggattctacaacactgatggtacaaacattaggcaggcgctgggaagcaaaagtatactggagagcaaaataaaaaaatgttaagaggaaaattattttttaagctggatgagaaaggtgactcgttgcataataaaggacattactaacatattaagttctggggcccgagcaacaatcagggataataccataagccactcgtaataaatattttattttttaaaaagtgcacaattcaatgaactgttataaactgaacacacccatgtaagagaactcagatcaagaaacagaacatggtcagaaacctgccactatcctgacgtctacaggctggtgcaaaagtaattgaggttttttttcattgccattggcaaaaaccgcaattacttttgcaccaacctaatgtcatcacaagttggttttggttcatatacttataaggtattgaaaaacatttgtgactgaatttaaaactttagtgtgggctgggcgcagtagctcacgcctgtaatcccagcactttgggaggccgaggcgggtggatcacgaggtcaggagatcgagaccatcctggctaacacggtgaaaccccgtctctactaaaaatacaaaaaattagccaggcgtggtggcgggcgcctgtagttccagctactcgggaggctgaggcaggagaatggcgtgaacccgggaggcggagcttgcagtgagccgagatcgcgccactgcactccagcctgggcgacagagcgagactccatctcaaaaaaataataataataattaaaaaaaataaaaaaagtgtgatatttcagaggtgagactctgggaacagcacagggtctttctagaagactagggtaaaataatggagtgaggtgctaagaatcctcatctagctctgctactagctagccatgtgactttggctagccccatcacctctcaggagccttagtttcttcctgtttaaacatggaattggtatattctattaactacttttaaaattagaatgcaggcattgcatctgagggaaagacttgattcctagagcgtgagcaggatacagatgagattagattgacaaaataacagagtggctggaaaaaaaaaaaaaggagaaaaggtctcgtataccagatttggatgctctaattgaaagcagaatggcttttagacttcaatcctgatttatattactgaagtgtttttatgagttaatgatgaattacatgtcaacactgtttattcaaaagagaagtcttcaaaagagcctattaatttgggggatttggcttttgttgatgttttgaacagaatgtagatgttaacacaaatgttttccaatcctcagtgttattgcaattaagctgaagtcaatttcagatgtctgctcaaaataagaatgtgtggctggttcatctgtgattagaaatagcttggatagaatagaaagctgagccaaacacctgagctatggccacctttcatgtgacttgtgtggctcatgggtctgctgcagaatgtgaaatcacttgtctctactgggaaataagccatataatttctcacaattcactcttttatagatgactgggtatcatttcactttttaagactgtttaatgtttgatgataccaatactagggccaaaataaaagcaatttaatgaaaagtttaacaatagcctcatctgaaagatcatcttttactgaatctccctcaactccacaatttccatttctcagactacaagcaggattgcttgttcacttttgaaataagctatctaataaagcagaagaaggacactgtcttagtccattgtctgttgttaaaataccacagaccaggtaattaataaggaggagaagtctattcagctcacagttctggaggctgaggagccccagaacagggcactggtatctggtgaggccttaatgcggcatcatctcatgaaagaagggcagaagggagtacatgagacagaaagggaaagaggaggcaaactcctcccttttatcaggaacccattcttgagataactaacaacccactcctgctataatggcattaatctattcatgaaggcagagccctaatggcccaatcacctcttaaaggtcccctgttaatactgttactacagcaattaaatctcaacatgacttttggaggggacaaacattcaaaccacagtaaacatacagcatttgatgcctaatcattctgcattgttaggttcctttcattattaacatatttattgatattagctcattttaaaaaggctttcaaaaatgagctaatgtcaataaatacgtttttggatgggactgaatttacttaaaggaacaaatgtaacatatttgttcctggtacaaatatatcattcctctgaactttcacagtgactctataagactattactccccactttttagatcgtgattttttcttctctcatcctagtagatatatctttagaaaacaaagtgttttccaatgataaacaatccaatcctttctctaaattgtaataactataaaacctcacacaaaagacttttcaccatctgcaacagtcaaaagttatttatccaggtctaacaatatactaggcatcatagtgaagaaaaagtagaaaataaagaaaagaagaaacaaagggagaaagaaagaaggaagggaggaagaaaaccacctgactaccatgaaaaggataatgtaatgttaaaaaaaaaaaggtcacaatattccaattctgggtaagatgcagtaatcgtacttcaccctgtctttcctactgaatgcagctgaaaaacctgaacaaagtgcatctgaacagctctttggtgattctgaaaaagtaaacattagcaggcagactaagaatttggggccgggcatggtggctcacgcctgtaatcccaacactttgggaggccgaggtgggcagatcacgaggtcaggagatcgagaccacggtgaaaccccgtctctactaaaaatacaaaaaattagcgaggtgcggtggtgggtgcctatagtcccagctactcgggaggctgaggcaggagaatggtgtgaacccaggaggcggagcttgcagtgagctgagatcacgccactgcactccagcctgggtgacagagcgagactccgtctcaaaaaaaaaaaaaaaaaagaatttggggtaacactgaattggtgttgctctggtatcccaggactagactaaaatcagcccaaacacagaagtagacactgggtacagagagagttccaggagaagccctctatctctgactctaagagtggaaaagaagaactgtaatgcttcagagagaatgaagaaaattccctggttttcttttatgttcattttctccattatttcatgacccagcccccatataaccctgtggtgacagtgggcaggagtgacagcagtggcgactacagcaattgtatagcaaactctagatacctaaaactctgggaatggagatttttttctctgtagagaagatgtggtcttaagagggtaggaagactccttgtgactttttgtctttcttggtcttccccttgctcaataaactttttttttcaatcttctttttaatcttggttttttcagggagctgtgggacaatatccatatgtttaacatttcagtcaatagagttcaaaaaggagaggagagagagtacagtgagtgggataaaacagttctcagaggggaatttacagcatcagatgtttatattagaaaaaggaaaaggcctcaaaacaataccttaagcttccactttaagaaactacagaacaaaacaaacccaaagcatgcagcaggacataataaaaataataaaggcaaaagtagaaattaatgaaacaacacaatggaaacaatcaaaccaaaagctgttttttgaaaatattcatatcattgacaaaactcaagcaagactgacaaagaaaaacaaagaaaagaaacaaattaccaatattaggaatgaaacagagggtatcacagcagatactgtgtataactctacacataactttgacagcttagatgaaatgaaccaattcttcaaaaagcacgaactatcaaaactcactcaagatgaatagataatcttcctaaaaataaatctccaggcacagtgatttcactggtgaattctatcaaatatttttaaaagaattctacagaatgtcttccacaaaattgaagtggagaacacatgtcccaactcattttacaaggctagcattactctgatgccaaaaccagataaggacttcacatcaaaataaaactacaggacaatatcagtcatgaacacagatgcaaaaatccccaacaaagtattaccaaataaaacacaacactacataaaaagaataatatggtaacaccaaatggtacgtatcctgacagtggaagcctagcttaatattcaaaaatcaattaatcaatgcaacccatgacattaacaaactaaagaagaaaatccagatgatcatatcaattaatacagaaaaggaatttaacgaaatttaacatccattcgtgatttaaaaaaaaaaattacagcaatctaggaagagaagagaatgtcttcaacctgatgaaggggatctacagaaagcccacaattaacattatactttacgatgaaagactgaggtgctttccccctaagactgggaacaacacaacactcaatttcactaccctattcagcactatacaggtaatcctagccagtgcaataagacaagaaagaaagaaaagatacaaagattggaaaggaagaaataaacctgtctctggccaggcccggtagctcacgcctgtaatcccagcactttgggaggctgaggcgagtggatcacctgaggtgaggagttcaagaccagcctggccaatgtggtgaaaccacatctctactaaaaatacagaaattagccaggcatggtggtgcacacctgtagttccagctactcaggaggctgaggtggaagaatcacttgaacctgggaggtggaggttgcagtgtgccgagattgtgccactgcattccagcctgcgcaacaaaaggagagaagaaagaaagaaaggaaggaaggcaggaaggaagaaaggaaaaacctgtccctattcacagatgacatgattgtctatgtagaaaatctcaaagaatcgacaaaataacacttgaggttagcaatatcacaagatacaaagtcaaaccacaaaaatcaattgtatttctatatacttgcaataaactattagagaggaaagttaagaaaataaaaacatttccagtagccccataaaatgaaatacttataaatctaacaaaacatgtatgggatctgtatactgaaaactaaaaaatgtttgtgaaagaaatcaactaatatctaaataaatggagagatgtaccatattcatggattgaaagattcaaatattaaggatatcaattctcccccaaactgatcagtaggtgtgacataattgccatcagaatactagcaaggttttgcagatataaacaaactgatcctaaaatttatatgaaatttatagccaaaacaattttggaaagaagaataaagttagaggaatcacactacccaattttaagacatattacaaaactacagtaatcaagacagtattggtattagtgaagaaataagcacataaaccaatggatcagaataaagaacccagaaacagatctgtacaaaaatttccaattaatttttgaaaatggtatgaaagcaattcagtacagtttattacatggcaagtacacctcaagtaaaaagtcgtttttaaaaaccctgtgtgttcttctcacaattttttttattccagaaatttcaggaatgttcaatgcatgaagaggggcctttgggattcacaaaagtgggaaattatttggcgttcatccaagcttttttttcccctaaatttagaaactagatgaaaactgttctgttacttctcatgtaatcagtatccttattaagcactcagcattgaatttaacattaggtcttgagaagaataatatatgataatatgaagtaatacatttcaaactttaccattgcttacaaatgaattcaaagaaaaacatcaaagtcaaagtacatttcttacatatcaatagtaccaaagaagactaaaagccctctgttacaggctcaaatgatgcaagttccttgaaatgaaaggacatcaggacacttgagggcagaacaagtaggcagtgggagatttttttagggaggcctaaaaaccagcctggtttggaaaagcatggtaggagacacccacgtccacttgagcttacagtaaatgatctgcctcaaattgccagtggccagtggttacttaacggccatggctagcaatttgcgggtgtctgtcacataaagtccagtgagagagacagagaaaatggctagtcagccctctacaaggagcagaaatgtgtgcaagttgttttgtgggaggtataaccataccttacatttgcactgtatattacaaatcacttccctaaaagagcaggtggctttgttcacagttggcagacgaaagcagaagttgcctgagtttaatccagttagcaggtggataataatattgaacatctttggtttaagtatctgttcaaatattttgtctgctttaaaaattaggtggctttttttcttgttattgagtttagagagttctttatatatttctttttactctcttagtggggtctttggaagagaagtttttaatttgaataaagtaaaatttatcaattataccttttatagaccatgcttttggtgtcatattcaagaaatctctgcctaactcaagttcacaaagattttctcccatgttgtcatcaagaagtttcatatttataggctttatatttaggtctatgatctattttgagttcatttttgtttaataaagtctttgtctttgatagtatcaataaccattggaaaatgagcctttgatattcccagggatgctgatttactcacttctatgaactttcaatgaatctgcatatgccacattctgtagctaaacagcctaatacacttggctagcaacctgaggtccagcatctaatcagaaggcacccagcaaacatcctggaaaattaaactcccatctccaatatgccgtcccaaaccagctctgtagtggattgcctgcacagtggccaccgacaattcctcccaccctgcacatgcatataagaggtagactccatccactaccaccaccatcccaaatatgggcctgccttgtgattttctttgactaatagaatgtaacagaagtgatgctgtgacaattctggatctatgccttaagtgtcctggtagctttggcttttgtccactgggaggccagctgcatgtaatgccagcttcctgctggagagtaaggcaacacggggagatggaaaagagctaaactatgcagactgcagagaggcagagagagggaccagccatcccagcgatttcagtcatcccagatgaagtgtcagacacagacacatgagtggaaccatcccggatcctctagacccagatgagtcaccccagacaacaccatgtgaaccagagatgagccgtcccccaaagtcctgcccaaactgcgggatcatgagtaaatacatagttgtcacttatttaaaccactaagttttggagtggtttcttatgcatcaaaagataagtgaaacaacctccaagtgtccatcacagaagccttctttacagttcattcagtgacctagagagttctattcagcaggagtcaattcagcagtacaaagaactctggaccagaaaccaaaatcctgggttaagttccagcttagccattgtctgagttcccccaaaagcacactctaagacaaagtacaagtagttcatttgggaagcaatcccaggaagcatagcgatggactagagcagagagacagcgaagagaagaaagacaataagggtactgctcactgggcaactgctgtgagtcactgttgtgggcaattggggctccatcctgctggggactcttcctccctctctggcatccaaatactaccgttacataacttctttccccattgaggctacacttaaatgttcattttaactttatttcatccagaaataaatggcagtagaatggctggctggtgagagaatgatccctgccagacatgagctctcagagacagccttgcttccacagctgtttcatcagaggcaatattagacaatattccatcctcttattcaaactcttctatgcagaccccaaaaggaagaccctaggcagagtccatggcacccataatccccaggccctctgtctttcattagcaaagacaattaaaacagcatgtggcttgtgaaatatcaattgtggtcctactttacagagccaacaaaaataaacttaaaagaaaagctttataaatgaaggcattactctggtccaaggggaaaataatatttttccaatttagtctccttctattgtttaatactacgaagggccaaagtgtgtccctgcccattgcccagagatgggagagaggagaaacagaaaaaagacaaacacctaaatctgaggaggtcagcccaaagcaggggacctcaataaatgccaagtcctgttctcaccaaggggcattcacaaagctctgtagcctgactgtccccagtcaacacagacagacaaaaagagggctagcctttaaagtaaaaccagacagtggaacaaaagcaatttgtgatgtggcatgtggtccttcaaatgcttaactctcctctatagaggtcaaatgggacacagagaaaatctaagaaaggaaaggaggatgcagtaagactttcagcagaagactccagaccaagacactggcggaggccacatggcctcagagagctatgagcatgggagggatacactgagctggagaagagctctctcttgcatcaagttcacatttgagggttatcaaattgcctctgttccctggcaaaggagatgattccactcctttacaatttggttcagaaggcaaaaacaaatcaagaacccatccatccacatcagctcttgaggcttcaactccatttaaacaaagacagagtaaagatccaggcaagactatttcaaaggcctaccccatgttctgaacacctgcccaatagaacagtctgcaaacttttaaaacagtgtttttcaatgtgggcgctatgggcattctaagggagccaattctttattgtgtaggcctggccttctctatcattatgacaacccaaatcactaccatatatttccaaagttcccataggcaatggcatggaaatttaacaaagacatcttaaatccatttatgccccgcccacacatacatttgtgggtatttttttctttataattgaggtaaacatatatagtaaagtgcacaaatcttaagtgtatacagctcaatacattctatgtatgtgcatacccatgagacctcccaacccagatcaagatacagaatactgctggcacccttgaagacccccttgtggcccctcccagtggctaccccataaagacaactgctattctgacttgtaacaccatggactagttttgcacattgttgttgaactttgtagaaatggaattgccatatgtactcttttgtgtctggtttatttcactgaacattatgtatgagattcatccctgttgttacatgtagcaatacattccttttttaccttttttgtttaagaatcgtaagcacagaaaagtgtccagaagtttatatcaaactactgagtggcaatttcagaaaaagagaatggaatcaagaggaaaatgaagggtgggcctgctttcaactttttatgcctctatttgaatattttcataatgagcatgttttacttttataattttattttaaagaaagggactcactctatcacccagtctgcagtgcagtgcatgatcatggctcactgcagccttgaccacctgggttcaagcgatcctcccacctcagcccctgagtagccgggactacaggtgagtgccagcacacctgactaatttctttttttttttttttttttttagagatagggtcccaagatgttgcccaggctggtctcaaactcctgggctcaagagattctctcgcctaggcctctcaaagtgctgggattacaggtgtgagccactgtgctcagcctatatatatatatattttttttttgcaaaaaattttggaaaaaaagtggtcagcctacaatttttgaaagccttgttaaagtacattcatcagaggatactttcagctcatctgcaatatcagatgggccattttatagatatgtgtagcattcagaccaccaagccaagaaaagtaaacgataatatctattttctgcccaccaaaaacatagaaatggaagttgtcagttgtctcatctattttcactgaaaatcaaggtctgcatggctttctcaaccctcattcctctcctcagcggccagcccatggaggaagtagaataacttagtgcttcctcccaactcaccctcaagcctcactatcactgagaatttcaaactaagtgacaacacagcagttacatatcctcacagagtaaacactaaaaagtgttcacacacagacccatggctgtgacaccactagccatggaaggcaaaggaagaaggtctggaatgggagggagtgagctgagctttgagaaggaagacacagcctcctcatgctgagagccatagcttccctcctatctgaatgtgtcctgaggcttcccatggagaaaagggtcactcactcaaatgaaagccatttggacttggctggcctgaaaagatgagtttggaatttggatgaggaaattttacagaagaaagtattctgaaaggaagtaacgtgaagaggagagagaaacaccccaagggctgttccccagctttctttacatttgaatacacaaaaacacattttaaagaacacatgttggcaacacccaaaagttggtggctttcgtctcaaaaaaacttcctttaaccaagacacaattgctagagagacagatgtgggacagatgatgctacccaaaggttggggttttttttcttccccacttccacctccccaagcctgcagtggtcactgccaccagtaaatgcttcaggaaaaattcaatgtcatgttcccaaatgtcctgtcctgaaaccaaaaacacagtgttcactgaaatcaacaaatgtgaaacactaggctagtgagatgttcggagaaaaccatttggaaacgtccacaccagtggttctcacacttgagtgtacataagaatcatttggaggatctgctaaaatacagatggctaggcccacttcccacatacccagcttgtgattcagtagctctggggtgtggtctgagaatgtatatatctactaggttcccaggagatgctgctgctgttgctgctggtctacagaccccactttgagattctgtggtcctcactattcctccttgtcctctctcagagagtaacaaggtatactggcatatcaatgaccctgagcagtcctgcaataaagaaacctatttaacccagccttttgcaactaaattacagtgcatcctgcttcccatataccatttctgaatgtctctgggaagcagtgcttcatggaaggaagtaggagacggtggagagctatgggccatactacataccaagatcctggcagggcagcacatctggagactgctgtctagaaatccaggaagcattaagaaatatgtcagcaggtagcaaaagccagtccacctccagcctcagattaggacactggatcctagccaagaattggcaagaataaaacagcaacctagtttttagagcatctaagatatcaggaggctaccaagcctcaaaccttgagaatgagacacccagttatgtgtcagataaattaaccgtatacaaggctagttatagcatgctggcctggacctccaagatgagtcctgagctgagcctcgtggtggggaagaagtagccccaaacacccaggaatcttgttaaaaggtaggtgcttatttcatatctgtgatggtgttcaagattctacatttctataaagctcccaggtgaggctggttatcaaaccacactttgagtaaggccttggattaggggttcggcaaacattttctgtaaaggaaaatatttcagctttgcaggccatatggactctgtcacaactattcaactgccatcgtatcaccaagtagccatagacaaatacccaaaggaatgaacatggctgtgttccaataacatcaaaatttgaattttatatcattttcatttgtcacaaaacattattattcttttgattttttttcaatcagtttaaaatgttaaaaccattcttagctcaactaatcatataaaaactggcagtgagccatctttggcctgcctggactttgtttgcagaccttcaccctagattactggtccctaacctagatctaccaaatcaaaatacacagaggcggagccagggaaaccatatttcatcagactccccaggtgatccttactcagcctgtacaaataccattgctggccagacacggtggctcacgcctgtaatcccaacactttgggaggccgaggagggcagatcatgaggtcaggagtttgagaccagcctggccaacatggtgaaaccccatctatactaaaaacacaaaaattagataggtgtggtggtacgcgcctgtaatcccagctactcgggaggctgaggcaggagaatctcttgaaccttggaggtggaggttgcagtgagccgagatcatgtcactgcattccagcctgggtgacagagcaagactcggtcaaaaaaaaaagaggaaaagaacagagaaaaaaaataccattgctgggttggaaactactacttacccaactccctgaaaaggtgagagaccctctttaagtgctgttaacagttcagtcttcctgacatccccaattcatggagcttgaggggcttaatgtgaggggctgtgtgttttcctgactaacccactggtctcactctcactcatctcccaaggtgctgcctccccgctaaccccagtgtcattgatttctggtatgaagataagaagtccctgtgtctttaagagctgatcagttccaggaattctcagccccaggagtcttgccggagtggcaggagcggccctgatcacactagcctggttttcttgacagctaaagttattcatcaggtattaatacatcttagctgcaggaaaaagccatgcaaggcccctgttaccaatcagcctgaagatgtgctttgctgctgctcaaggctaagccaggcaggggctgtattcctggcagaaaggcttaaaaggagatgaagccaagggaggttgcatttgtttttgagttagagaagggaggaaaaacctaacctacaggctgtacatgcttatctcaggaatgctggggacttaggaaaggaaggtcagaggattcagtgatgaaggcaaagccaacaggaaaagggagaggaggggaagtgaaccattgtgtgtcagttataaacaggcaagccactctgtcttggccaagggctgaactcattcatcagaccagtacttcctaaatttcatcatgtagaagaatcattggaaggatcttgttaaaatgaagatgctgattcagtaggtcttgggtttgggcctgagcttctgcaattttaacgtgctcccaggtgacccaagagttcaccacagatgctgctggcatgcaagcacagctttctgttttgttattttacagagtcacaagctctaaaagaatatggggtccatagcttgtccacttggagttaagctactgacatccaggactacatagatatagttcagggagttccctgcactacagcacccaccgtcacaccctcaaaaagagcaagtggggtctcaaatcaagcctgtcctccactctccaagtcttgaatccttggactcaaggcctcaagtccttgagtcttgggcctgcctctatccttttcttgcccaaagtctgtctcctgaccaagccctgtgtccacagatctacatgtggccagatgggggcctctttttctaattcacccaaaggtgctttatgcaccagtggtggccctgcagccagcattgagaggtggccaggcaccattggctgactctggctagtatcctgccacagttgaaccttgaaagcactatactaagtgaaagaagccaaacacaaaatgataaatactgtgtaattccatttttatggaaggtcaattgtaggcaaatctatagaggcagaaaatagattagtggttgcctagggatgggggattaagaaatgatggctaaggtttggagtttatttggggggcaatgaaaacattctaaaattggttgtggtgatgaatgcacaactctgtgaatattctaagaccattgaattgtacagtttaaatgaatgaggtatggtacatgaattgtatctcaataaaactgttatgaatttaatcacaaatcagttggggagctcaaagcaaatggtatagagaggaagcatttgggactctgacaacctcaaaagagggcaaggactgacactgaggcagcaacttctcagaactcttgaaaaacatccaaacagctctagatatgagatgctgagagtacagccaagtgtcaatataaagaatagccctgagatacaccctggacaggggctcagtgaacaatgctgtattcgtccatttttgcactgctatgaagaaatacttgagactgggtaatttataaagaaaagaggtttaactggatcacggttctgcaggttgtacaggaagtatagtagcttctacctctgaggaggcctcaggaaacttgcaatcaaggcagaaggcgaaggagaagcaggcatgtcttacatggccagagcaggagcgagagagaggaaggaggtgctacacactttgaaaacaaccaggtattatggtaacttactattgcaaaaataacaccaaaggggatggtgctaaaccattcatgagaaatccgccccccatgatccaatcacctccagccaggcccacctccagcactgaagattacatttcaacatgagatttgggtggggacacagatccaaaccatatcaaatgctcagtgccattcattcttgcctgcctatctctggttccccacaggatgcctgacatgtagggatcactcaaaaattgaattcaatgcatgcctatgaagtgaaaggaattctatagccactagactgaggtctactcccaactctgcatttaactctctgtgtgaccccagacaaatcccttcaacttgctaagcctcagaggctcctccctaaaatgcagggcaagttaccatctcaggcatcctcccagtctgaggttccgtggttccatgaattaggcaacccatgcaagggagcctgggtgtggaacagagaaactcctgcagaaatctagataaagaccaagacacccacccagaggctcagaactggccagaggcatgccccccagcacatgtcactccacagatccactgagagcctcccagaagtcaggctccctgctagaccatgagaatacaaaaatgaacaagatcccacaacctactcacgtggctgggggcatcagctccgtgaataggtaatggtgcaacacaatgaccctactccttggaaagctgaattaaaatctaagtggaaacaaaatttcagtgttggggattgaaaggaattggagccttgatctgactaacactgagtcagtaccaacatgtctgtcagagttcctataaggaattgccactttgtgggcagaatctcaggaggtggaggatgtagccgctccaccgcttcctcaccactccacaatgggcctgccaaaccttggcttaattctcaccctgtggccctaatttaaccgtgtttgcgaacaatcttggatcactgggattggcagggtcattcagctcagccacccacacaataagcggcaggcgagcgtcatccattagcagatcatggggtgtaatcagcattgaggagattctcattaagtactactggatgtacattgcaaacagctagtgatagcaggggaaatgagctgctagtacatgtgactacactacaggtcactgtaagagtgggacagaagaaatattgcaatgatatttcaaggccaaggcagaaagtctgtccccagattctatgtttggatctattactcagaagaaagtttgaaaatcattatgctcaatttacaaccccaaacctctgggataatccaagccattatgtccaaacccatttatcttctccctggagaacaatgcataaagaagcatccattgtgagctaaggattacgggtgagtgaatcattcagctcgggaatgagtactccagaggtttctgaggtcagaatgtgccagacacccgtaagatccaggtgctaccaattatcatctggaaaacttgggagcttagcagtgctaccaaggacttttctcttgcacaagcttttcctctaaatctttatctgcacatcctgcccccagaactcccttgagtttctaagtctcttagaatgtcttacggtgatttgacatccaagagccttcgcaattaactatgccctgattcgttgcctgtccaaatggacaaatttcctttgacatttagctatcttgcaatccgttttctcaggaaagtgtcatcttggaaattctggttaaatcctacaggggagatttgaaatggaatactttgattcacaattacttcaatcaattaatccacaaatactgactaaagatcctcccccaagtcacactgtgtactaagtggggcaggggggtacagcaagttaccagcccaggcctgaaggcaattacaatttacgattacatctgttttgcttggtactgctttttaaatgaaaataactggaaactatacagctggctgtaactggaaaggccacctgctcactggttcaatcaaagtttacctactgtggtaatttcatcttactctgtatgttgatttttctgcccattaagtgcatattttctcatagaattcatgaaggtgctctagtaactagtggttttgaatcgggatagagccgtctccccagaaaaaggacactcacacagatttttgtctccaatttcaaaacattcttagagaagcccacacatcctctactttcacttttcttgggcctttagtgccaccatctccgcaccagcaagtctcagcatcattcttcaataaccaattccagtgttcccacatagctcctctctgtgctccccgggcctgtcaatccaattgtattataacattgaccacctgaaataactatgtctctatttccccacaagacagaaagctacgagagagaagaaattgcataccttcttcatcgtggtctcccaagcacataaatgcttcatcattcagtgttcactttaaaaataagtctctgggcagagcccaggatttattagaaaaggtagaaactgattctatttcagaactaaacccaaatttcccagagattcaggcttaaaagaccaccctcctaaaacaaatggcccataaaagttagcagttaagacatcacacagtcaagaactgaggggctggtttgagaaactccctatgaattggaagttgggagaggttattattcacgctgctattttggaagcgaatctctaacctgggcattaatcataacttgcctgctacaaatttcatactatgttatagcctggcaaaactaaaccttcttctgttcaaattctctcttcactttcaattactaatttcagttgtgttctctgaaaggggaattgacgtagcacacatatttgcgtttactaaggaaaccattcaaccacttgggaaaggcacagatcaaggtggccaacaaaaataataaatgcaaactccagcttgcggttgcagtcagtctctcatcttacagcccccaacagagaaggttattgcttaaacagagagtgttcgtatatttaaaaggaacctctgtatccagtaagccatcgtttctatgtatgtagattcatggtggcacaaagccctgtgtacctgtgcacatgtttccctcagctcctttcctgtccaatggcccatcactggagttacaggcactgttaatccattacgcacaaatatccatgtggcacaaagtgctctgctaggcaccgtgggaaatacaaataagggtaagacatagcacggcccctgcctccaaggtcttaaaatctacaagaagaagagtgcataaattatgataatatacagcattatcaaatatgtgatatatgtgataaatataagagacatgagtgagaccatgggtgttaaaaggaaggcacgttgcttcccattggagcgatcaagaaaaggtctcatcaaagtgggggtgttgctggatgatgggcagaatttggacaaatggcaagggggaaggattccaggtacagaaagcagcatctgccaagaaggaaaatgtgactcaggttctataaggataggattttaggaaaccagggggaaaagactggaaaattaggctagaagcaaactgtgtagccccctaaaaacaactgagaactttttacttgagtgagaacagggacctgctgccctaagtttttgagtaagggagtgatgtgataaaaaacagtactaaagtcaatggacttaaaagaccattatctaaagtgagaaagtaaaatgagctagaattagagagaccaaaagtgagaatgttatagcaataatctaaaagagaaaagcagcactttggttatggtacgaggactgatgaggtgggaagatgtgaagacgctgctttaacaatggtttctggtgtctcattcagctcccaaatctgcgaaatgagtagtaactaacaaacaacattgtactgtactgaaagtgttatcaatgaagaaaatgccagaggaaaatgacctgctctccccagcatatttccttttcattgcagagtacttttgtcagctgattacatgttttaaatctaaataggaattcctagcctgttcccggtgacaccttaattatataacctgagctaggtgctccattcctagtacttatctccaaatgtggtatttcaaaagactgcttcagctgatgtagtctggtttggcttttagcaaacctcacttggttttcctgactagtaaaaccacgctactttaccagttttctccagatgtaagattcacgaagcctttcttagaggccatggtactcattctccatcttcagccttgtttgcagaaggaggcagagtgaaccaccactatctcacatgcaaatacagctctaagaattattttaagaacagaatctaaattctcatctgttataagcatacaaacacagtcaaacacaaacaacttttctacaaattttccatacacttcatgtaggtttttatagacactgcatctttgctaggctgcaaaaaatagatcagagagccagaaaagctgcattaaattctaagatggaagaactccagagaccttctaggagtgggaatgagaatgatttactctcactctgacagatgtgctattcacgtgcagatagttacataatcgacttgctgatggagccctagatctccatcttctttcagaagttccagattcaagtccttcactttctctcttactgaagatatgatgtccacttgctaagagagtgtctctgaaatgatctttaaaatttgtcacccagcacttagagtgaactcagcctatgtgatttgctttcagacccaagggcctagagattttcccctccccagccttccaaagcctctggcttggactgaaatcccctcctctggatctcacaacctcagcggagcacacttcccaagagaccccattgagccatgccaaaaggaggctcaagaggagtgtttatcaagcagctccaatcagcttcagctcatttgtggtctgagcagagccggagggcaggttaggagtcagtggaggtggtggcaagcaggaacatggtggctaaaagttgggagcagcttgcaggctggcagagggagccaggaaagccagggataggtcccaaaagacaggtggtagtgaatgcccaaactggcgaactcatgattctgtggctgggccctggtagcaagctgtactatataaaggtggaagatgagagaaaggagaggggagggcaggggaggagaacggagggaggtcggatggaaaaggagaaggggtccccagcttgagaaaggctcaactaaaagttgaggttcccaggcagctcacaggcacctcccaactcagtgcggaaaagctacctctagcttctcaccttatttgcccgctcccagaaagctgcttctgggacgcttaatgacttcctcttcccctacaggttcattttaacctgattcctgctaaagggggtgggagaggaggtattaacacaccatgggaataacagttgcctggcagtaaggataaaatttcctttccactttaccctgaatcagttcctacaaagcagcttaaaacttaagagtcagctcaaaacacaaatgttcctgtttattaatttacaaatttgttctattcattcatttatttaggtgcgtgcagagaatttcccgcagccatccctacatctcccaagcacactgctagaaagatgggcatcctctatccttctaccagaactcagtaggttcatttctcataccctagatttaagctgcccacggtgttgaacgcagagccaaatatttgcacgccctatagccgacgtcacccactttcccattaacactaaattaaaacgcatccatggatttcctctccattccgaggcaacaggagtgcatggcacattgccctactcccctgaagctcttcgctaacctaagactccagggtgaggaagttagctggagctttttaaagtgcatctccaaagagaattttgctcacaccatgagagcccccaagaaacaccagggcccccttagatgccggagaccacgccctccaggaataagccgcaccctctgcccagcagatccttgcgcgagtagccctctttccctggggctaatcaagtgcatgccacatgtcaccactctcagctggcaattcttcctcagaggcgcagactttctcggaatccccagcagggggggttaagagattcaggggaggccccgcccgtgccttccacaaaagtcgctttaccgtggctcgtgtcctgcggccccaagggggtagcctgggacgtgtagtgggagggcatagaggctccttccaggacaagctgccagcctccagtgggcaaccatgtgagaggcaaaattctgggggtgagaaagtagcaaactagtctgcggccaaactttctctgtggagcctcctacaccgaaaagggtttgattggaactctggaagcccggacgcagaaggtgctagggctcccgtcgccgcgagggcgccccgcgcctggagatgggatggtcagttcttcccggcgcgtgcccagacaccagccccgatccgcatcatccccaccctcgggctgcgaaagaggagttctgcgcaaacaaagggcgcccccggcacctccctctatcccgagcgaagggtcccaacggcgactccgggggtctttggtgcccagctgaggaggcagccacgcctccgatcctacctgggaagctgcggctgggcgggacgcgcagcagcagcagcagcagcagaggcggcagcagcagcagcagcgcgggccgatgtgcggggctccccatggcgagcgggcgcttagctcgcctcggcagcgcagcgcgcttcccgggggcggcaggagaccgaagagaccaagggactgcgtgctagcgggcgggcgaaggccgggctggaaaactcctcctctcgcctctttccctccctccttcctgcctggggcctgccctcctttctccgccccccctggaacactgcgcggttcggggctctgacccacccacctcctccttttgtgccagcgctttttctggccagagagcgctggagacaagccccagcagagcgaaatatcctgaagtagctttctttgccccaatttgcgcgccccctcacccggaatacacacacggtattcaatacaaccgcctcgaacatcccagacgtctagaaggataccatctgtgcagaaagctgcgtgagtcacacggaaacagaaggggcaaccgaggggattcagagtggcccactgcggccggatactatggccatgttctctgttttgatcctcacgaccatgccccaagttcgctattaccatgtccactttctccaataagacaccgacgcttagaaacttgcccagattcacccccgttactggcagagcagggactggaacttaggtgtgtagttctgccgacgtcaaagtccatactacagattttttgttagtttgtttctcttttgcaaaggaataaatcaaggactggaccgggtgcgtgcctgctctgctgcggtttaggatggggcttgaggttctccttccaggatcagctgatgggagagcacaaggcacagaaagttctctgtctcacccacagccatggggatccagctgtaggttcctgcagccagatttcctcatttcctgggttgttctcaaccaccccaaagataccacgaccagactggagcctcttccctgtggcttggcatcgctggatcctggcatcaggacagggtttctaggctgcccgcaggacggatctggtttctttgaggcatttgagtaagcctctcatagttttgtttgtttgtttgttgttttggttgtttagttcttgttaaatcagtaaggcaatacgttgcccctttgctgtctcagaaagatcttagctaaggcaaattttagttggagttgctgcattaggttgtgcagtttgggcactgtacaaaggcatccagaggaaggggcaagtgggagccaaaatccaaatgcctttgggttcagggagctttgcgtcttggcaggggccacatccactagaagggcatctttctctctgccacagtagtctggtctgatagctaggctaagagccctgggggcactcacctagaagttctgaatttgtttatccagaaggagtgccatttcccaattctcacaaaagccccagacttgaacgtccatcttaccctctctagcacttggggggacttcgctccatctcctgtgggtttctccactgctgctacctcttcagggaaccaacaacccttaaataaccccctagtcgcaaggaaatgggggaggtcagtctattctgtggcctccatcagaccagactttccagggagtcattctcaaccttgtttatgtgggtcacctggggagcttcatgaaaataccatatccaggctctacctcacactaataaaatcagaatctttaggaatgtgacctggagtttgaccagatgcatatttttgtctctccccaatccgctaagctccacggtataagttttagtataggataaaaattctagaccaggagtttctcaacttgggcactattgatatttggggctagatgattctttcttggggagggggactgccttgcacgttgagagatgcatcgatggcctctatgcaacagataccactagcaatccccctttccccagttatggcagccaaaaaaatgtctccagacattgccaaatgtcccccaggggaaaaatgcccccaatagagaactacttctttaggtctgtaaacaagggttaatgtgcaccccaaattccaggtccaggatagcctggccagcagccttcctttcctatgtcacctctgaagcaatgtgtcttcaccacaaccagtatacattctattactgggctgagaaggaacttctagctcacttctatccactgattctggctggattacaagaaacaccacacttactgttgacttgctctctggcctttgaatgtcctcaccacaaagaaagaaatcagaaatggatgaggtgatggtcacgcaaaatactgacttgacgcttggtgcagtggctcatgattgtaatcccagcactttgggaggccaaggtaggcggatcacttgaggtcaagagtttgagaccagcctggccaatatagtgaaaccccatctctactaaaaatacaaaaattagccgggagtggtggcacacacctgtagtcccagctactcgggaggccaaggcaggagaatcacttgaacctgggaggcagaggttgtgccactgcactccagactgggcaacagagctagactccatctcaaaaaaaaaaatactgacttgattttttctttttctttttcttttctttctttcttttttttttttttctttgacagggtcttattctgaatttgaatttgtttatccagaaggagtgctgtttcctggctggagtgcagtggcatgatcatagctcattgcagcctcaaacacctgtgctcaagcaattctcctgcctcagcttcctgagtagctaggactacaagcatgtgccaccatggccagctaagtgttttttgtagatatgggggtcccataaatatgtacatttacaatgtgtccattaaaaaaataaacaaaaataaaagacttgaagaaacatctctatataatgtttacagagaaaaataacatttgttgttttcattgtgcaaggatatcttgaaggacagatccaagttcagttgcctcttgtatcaataaatcgaaataaccctttcatttttacctaacaaagataaaggggagagaacaaggtggtattcttacctagtgggaatactaaaaggaatgccattgttgtcaaaatgtataaggtatataaatcacgtgggttagagtaatagggaacacaattagatataatattgggaaaccattatttttccttgacaagcttgaagtattcgatataaacccttggaagaactaatatgaacatgaaaaaataaaataagagcctggaatgaggaaaaaaagtctcttgctctcttttctaccctatagagaaaattccaatgggacttttatttttcttattatttttattccagttttctctctgatagaagagatgagggtagaggtaaggtagaggaagaggttgtcaattcatcccaatcccacaatatcttggaagacaatcagatagttaaatagattcataatctgtcaaataacttaagggttaatgagttgatgaaaacaaagagaagtcactcagggagtgccacagagctatgacaccattcctatcctgcttgatgttactatttatgaactagaaaaagatatttttggcaaaggacatgaagataggagggcaagaaacagattccaaacatctctctaggcaggcatgctgtattgaaacattaaaagacagcaaggataaatatgatgtcctatgttagatctcaaaaaccaatcacacatgaagaatctaagaatcactagaaagccaagtagtctccccactgcatcaggctcatctgtgcaaagaagtgtttataaggttttattcagcattgctcatagtaacaaaaggttggtgacatttttgtaaatgtaaatatccattaatggggaattattttattaattatgcatacctatgtaacgaaatactatgtggccattaaaaagaatgaacaagatgcatatgcatcagtaggaaaggtagtctcacatattttgtttaatgaaataacaagcaaaataatacacatatcttgctaccatttgtggtatggggaaggcatgatactgtatcagggtatggggaagtcagtaggagaaataattttttattactgtacaatcctttgtactgtttaaatatgtaagcatgtaatgatatttcttatttaaattaaacagatcattgaaaatgttttcttaaaaaaaaaaatcacaccgatacagagtaggagttgccagtagtggcttcacagtacaacctacgacagtgcaatctatttgcctataagctaagtctccaaggcacctcaggtgcatgcagacagtgtctgtcttgtcatctgaagcattcctgagtactgggcaaagtaccagaggtgagaagaagagaacacagacatcaaagtctggcaggaggagggaggtatctttccactctgtgcagtgttgaggaggttgtagtcaacaaaacagtcttgtcccctgagtcagagcagagtgagccccaggagacaaggaaggaaaaggattctcaagagtcacctccctgcccccaactttcttccttgagcttgtcgactcagagacagcattgaaagagaccctggcagccatctacgtactgcaggagaggtattttctaagaatcaaagccccgttatgcccctcccattttcccatgcctcctcattctcccagccctctcaagctgttgccggaaaagggatccccaagaatgggttcttggatcttcagcaggaaagagttaaaaggaagtcgcagagtacagtgagaagagacagtttataaaaagctactcagttacagattagggtgtcctcagaaatcaagaagaggaatgcctcatctttgttttaagtttttcttgtttaggggtcttatctatgtaaaagctaagctaagttatgtctacatgtgggtgggctgaaagtatgacaaaatgtattacttcgctgatttaaataaaactatccttggcacttaggatgccaaggataaatacatcttaaataaatacatcataattggcataaatacaccaaagcaatactataaatacataaaagcataaataaataaatacatcataattgacataagtacattaaagcataactataatgaacttgaaatcatatactgttatggatattgggacatagggatactctgttgctgtaggaatatgtccttgcagatatcattaagctgtttctttaaatataaacatgaccatgggtcatgactggcaaggaatgtgccttgttagtctcaagatggaggttaacttaaaatggcattagtctggctttcctactctacttctgcttccctaataaacccagttcttttctttctgtatcctttcacagtaaagtgatggaagtttaaggggaaatgtggtggctcactgtaccttgggaaatggattgccagtagagtaaaagtcaaagagatatttaggagtgcttcattctaaggcagttcttctcaaactacctgtggcaaaggactttttttttttttaatgtccaatccatcattgatccatgctttggtaaaatcagtaaagatgactaagtagaaaaataaaagagaaaacaagccaaagacatacacaaagcaaaagttcaaggttctctcattagattccacaaatctattatttgtaaataataataataatttgtaaaattatttctttctttctttttttttttttttttttgagatggagtctcgctctattgcccaggctggagtgcagtggtgcagtctcggctcactgcaacctccgcctcccaggttcaagtgattctcctgcctcagccccccaagaagctgggattacaggcacccaccaccacgcctggctattttttgtatttttagtagagacggggtttcaccatgttggccaggctggtctcaaactcctgacctcaggtgatccacccgcctcggcctcccaaagtcctgagattacaggcgtgagccaccatgcccagcagaagtaaaattattttatcaaattgttatcacagtctctaaggtcatactctccatttctgtacgtatctaattgtggaccagtacaaaacagttcagaaagcagcaccagtccagggaacacattgtgagtagcacagttatcgtggatttactctttcacataatacgtcagtacaaactacagtatgtatcagacttttcaagaattcaagaatagaagggcaagatgatttgacctgagtctattgaaatcatgtgaaacgaatgccagacgagtagggtgtgttgggttgatgcttgtgctcatgcatatatattaaaaatctagctctgagaacgcatggacaccgggaggggaacatcacataccagggtctgtcgggagtagggggcggacaaggggagggagagaattaggacaaatacctaatgcatgcggggcttaaaacctagatgacaggttgataggtgcagcaaaccaccatggcacatgtatacctatgtaacaaacctgcaagttctgcacatgtatttcagaaattaaaatagaaaattaaaaaatgaaaaatctagctctgagggggttaaagtaagaatgttcaaggtcaagatcaaagaagataaagacagtataagaatagtgtctgtttacaatcctttggcttaaagagatttcttctttttctagcgtaaatattcagaaggaaacaacacaagctcctggggttgaaaaacttctacagcacaagaaaaggaatatttttactaaaggttcaaagcaaaacagatctctattatgaaaataaactacaaaaatgaaaagcaattttagagaatatctattggtgctttcaataaaagattcatgaaaaattcttttttaaagtaggaataggtggtcataaagagaactgagaaatataagaatgcagaaataaaaattaaagttaatgactttctgtttcacctgcatgtgcttacaagccatcattcctgcccttacaagaaaaatctggacacactgaaaatcaatgtcttttctctgacccaacagagaactgagttttcagggcaaattgccaccatcatcatctggaaagacaaagaagtccagagagtcacagtcaagctctgcttacctggagcagaagacatgctggaaccataaacttaaatggcagtttggaaaaattgctggaggctgagtgtcgactaatatgacattgaaagacccatgggagctgaagtcatagctgggacccccacactgttgtgggctttacctccaagaaccctgccacgttttcatgatgaaggtccaagaaagacccttcctgtgctggcagcgggaggggaagattaatctaatcatttgaaatatgcccagagacttctccataaaaaaggactactttactaaggggaattactttaccagaggcttatcccacctaacagaagtgcatttcctgtacttcagcctccttagccttcctgtctcacctaagaggggaagttttaaaaaactaagaaatatctgcgaaggtcatagccgaaggtcacatgctcactaaaaggctgagatttcatcataatattatagaacacttttcctccccacaccctactacgacaccaacagggctccagcataatgacagtgaattccagctgaaagagcagaaagatccagattctccctgagggggagtattaaggaatcccaaagtcaagcagggagacaaaaaaaaaaaaaaaacaaaaaaacaaaaaacaaacaaaaaaaaacgcactagaggaatgtgaggtctctggcaccaactgtgattagcagatttagtctttcacgtgatacatatagcaaacatcaaatacagcacaaattctagcctgccaggtccttgcagttataagactgaagttccgttttcttaatgaatactagtcagggactactgtcagcaattagatatcactcccaggtccctttgacctgcagatccttccatgttagcaacagagaacctcccttgcatcaaatctctctcacactttgaatctctctctgactttttcttctaccaccagctagagaagactttactttagaaggactagtgattaagttaggcccacccagaaatttctttaccttagggtcaagactagtaaccttaatacatctagaaattttctcttgcaatgcaacctaatgtaatcatgggagtagcatcaggaagtaatggtcgtgggggccatctcagaattctgcctgccacagagagttcagtaaagtatataaatagaaaatgtatgaagattaatagcttattacccaaaataactagataataaaggtttaagctgtaaaacaaatgtatgatacaccacatgtacatatacacatattctaaaaattgtaactaagagccatagagaaaataattaaatgggaagatatgctatcttcatgaatgaagacagtgaaggccataaagagcttaatccttccaggggtagaccttgatttgttttcccagaacatcatttggggaactaatatggttttggagggggcctaacaaccacagatacctcaaactctagtaatggggtgtggttgcgtgaatgaggctgtgtcagtagtagaactttactcccaagacattgcaattagagggactggcacaggtcccaggcaggccaataagacacttgcttagggaattttaagacagaagctgattgagagaatgcctcttattttcctctttggttggccattgtatgaatttgacttaagaactgctagttttgattggagcccagaataagagaaggcttttgtctaggctgctgtgcgaactgctctgctacttgggacatatgacccaggagctccagtggtgcttaaagtgtcagtgacagagaaggatgcattttgaagtctttggcaagcccctataagtgacacaaaactggacccttagaattttggagctaaccactgccatactctgcagataactgctctctttttcagaaacaacttttgccttgctactgagcctttgtagagactggatgcttaaccatgagccactaactcaccatggaatctgagctccccatcgtgagtttgaggttgttcaactagataagccataaagttgtgtgtgcaaagaagcactccattatcaaatggaagaggtgtatatgtgatcagacttgatcaggccttgaagccacaagtaagttgcatgaagaagtagcccaggccaggtgcggtggctcacgcctgtaatcccagcactttgggaggccgaggcgggtggatcatttgaggtcaggagttcgaaaccagcatggccaatgtggtgaaactccgtctcgactaaaaatgcaaatattagccgggagtgggggtgggtgcctgtaatcccagctacttggaaggctgaggcaggagaatggtgtgaaccccagacgcagagcttgcagtgagccgagatcgtgccactgcactccagcctgggcgacagagcgagactccatctgaaaaaaaaaaaaaaaagaagtagcccaaattctcatggcccctacttctgctatataatttcacttttccaacttgtatcgatggtctggtggggagttccctatgacaaggggaaggaagaaaaacctcagatttggtttactggtgatgctgcatgacatgaagacactacatgaaagcagatagtggcagcatctacagtgttgctcaataacagccttgaaagacagggatgaggggaaaatcatcctcacagtgggcaggattttgagtagtctacctgggtacttgaatggacacttatactggatatggatttaccttctctgtccacaaagcttcttccaaaactaccatccataaacttaccttatctactatcatgatactagactgcttccaaacaaggaacccacatcacggcaaatgaaacatggcaatgggcccgtgctcacagactttactggtcgtaccatgctccccatcatcctgaagcagctggcttgatagaaacagagtggtcttttgaaaatgctgttatggccttttgaaaacaccttgcagggttgggcaatgtcttccaggatgctttgagtcagagtccactatatggtgctgtttctcccatagtcaatattcatagatctgctgggcgcggtggctcacgcctgtaatcccagcactttaggagaacgaggcgggtggatcacaagatcaggagatcgagaccatcctggctaacatggtgaaaccctatctctactaaaaatacaaaaaattagccaggcgtggtggtgggcacctgtagtcccagctacatgggaggctgaggcaggagaatggcatgaacctgggaggcagagcttgcagtgagccgagatcgcgccactgcactccagcctgggcaacaaagcaagactcatctcaaaaaaaaaaaacaaaaaaacatatatatatatatatggtcatacatttaaaaagccagcggtgaaaataggagtagcagcactcactattacctctactaatccattaacaaaatgttgcttcctatccctatgttgtaggctctactagtctagagatcgtagttctaagggagtaatactttcaaaaggggacccaacattaattccactgaaatggaagatgagactgctgcctgtctactctggataccttatgccattgaattaacaggcagaaaatgagattattttctggctagggtgttcagttctatcagggaaaaattgtgtgaccagtagcaacacaattgttactagtaacacaatagagtaacaatcatatatggaatgcaggaaatcttcaagagtgcctcttaatacttccatgtcctagattaaagtcaacaaaaaactgtaacaattcaattcaggcaggactgctaataccccagagctttcaagaatgaagttttgtgtcactccaccaagcaaagaactatgaccagctgaggtgcttgctgagggcaaaaagaatagcaatagatagaatatgggaaaaaggtagtgattgatattaactatgaccatatgacccttgcagaaacaaggactataagagttgtaagtatttcttccttattttaatataaatatgtttttatatattaaccagacattttattttttttcgctttcatggccccttatcatctaacacaagttgtcttaataatagtttactttatatcttagcacttaagttacaagctataaaatgatatatgtgaagcagcctggaaaataataaacgtcacccaaggacaaaaaaagaaacttgggaaaagggttagcatttttttttttcagttgtatgagagatagttatatcacactaggcagaggcatgcctttggcattatcattattcagtgattaagtatactttaaggagatatatatggatgccaagttgtctaggggtggattttaatggctttgtaatgttatcaacttgcctaggctgagctacacttcccagaattcactctcttgtttgtttccagttagggttggccacatgggagattcttgggagatttgaaggctggaagagaaacagtggccattatttcagctcatacatgttgttgtcgatctgctgactcacttcgttggtttgaggcaacagctgggcctgtaactgctctacttttgccctgattgccttttggtttctgtgactcttaggccaggtatgtgtatctagctctgtgacaaaaagtcccacttctgctagatacccttatcaccaaggtcagaggcaacaagaactaacatgtattccagttcttcttcatggggttctagcttgtgcttgttggttccaacctgttcttgatctccccactttacctgtctttctttccctactgcctgccccatggacttcaagctccatcatcagaatcagaaacaataaccatacagagactgcttatccaactctcacaattccataaaggcaattccctgtaacaaatccatattggctgtatgcaattcatatcccctactgattctgcttctttgattggtcttggacggatacaggtgaggagccagtgtggagagaattgagtttaaacatgttaagattacaatgcaagtgaaacaacaatgtaaaaatgtctacaggtaagataatttggaattcagtaggaaagatgaggagagaatatagatttgaaatgctttcatggaggtaaacgctgaagtcactacagtggataagattcttgggaacattggtgaaaaaggaagaaaggaaaaaagacaatatacaattagaacagaggggagtgaaggaagccatagcaaacatcagcttctggatcttgatagaggacatccaaatcccaaggaggaaaggcctttattttttgccagataggacccgagggaatatacacaagggcacatgacccaggactagaagcagactgaaaaatggaacaacatgaggacacatcagttacattttgtggctcaatctttttcctatgaggattgagctccataaccttaaagccctcactgtgggttttaatggagtttgtgaaactaccctttctgcctaacacagcaacagagaaaaaggaggccacaacacttctgaggcaggaatgctttaatgtggtagtgaggaaaccctcatttgtatccccgaggcaatgcatttgaaaaggaaacccccaatttgtatccctgaggctatgtgtttgaaaaggaaaataactggtgtaggactaggactttttaatatacagagactatcctcagagataatgcttccattcaactattatcatattgattcccccaacaagacccattttaggcccaattgggtctgctccgggtcctgcacacatagttctcacccttttatcctttattctcaataagatttttggactgcccacttcaaagatggtgcaactgcccccttgcagaaggctgcattcattgaactgtctctccctactcgcttcttaatccttactgattctgttgctgctttggcacatcctggggccttggtcttttagaatgctgattcatccagcaagcatctgctggaggtaacagccttgtcacatgtttcaagtcaaagaaggatgtgttggaggagagggaaagctttcatttactctcttgtaagcaacccaaaggtcagcatcactgccaggacttagactggaaaatttgtcctggaggctagagaagggtttccagctgcaagaacagctaatgtacatcccctgttggactctgtcctctgtcctccccactctctctatgtgtgtgctcactctaagctgcctctccctgtggttgtgcccatgccctttccccttcttttcctaaagacctctcctggatggtgagagtttctggctcattatgaggtcctcagggaggccaaagcacatgcagaaaccctgctgtttggcaagagctcttaaggctggagccaagtacaaaaaaaatggcaaagtttagaaacaatgaattagtagtccttcctgggttgcatcattctgttagtgataactaatcaaatgcttcatttagtcaaatcctgttggactttttgttccaagtgctttccaaggatcggcctttctctgaccatggtaaatagccaaagaaaagtcaatgcatggaaaggttacaagacttgcacagagacccatgagagttgaacacgtccacactaaatgcagattctgagctatcagcattggggttctatagtaatatttttcatgcagctgtttgaagcttttcctgctttcctgctctggttcttttctctctctgctggagtggattcaatttgtggtcatctggaacacataagttatcaacactttcccccatttgcctcatgttcccttctctcaaaaggagaacatgcagtgatgtgtctcttgagtatatgatctggtatatgaaatccaatgtttggtatatcttattctcaaatggatgccattgcatgacggtcatattatatcgtttcctacaactttcttcctttcaaaaatgttgcctaaaccttctatctccaatatcctagtccaatctgatgtctgcccacatgactcctctgaaataactcttgctgtcatgacctgcgtgttattgtcacctacagaaatattttagtcctcatctttgcacacctctcagaagcattcaacactaataaccacttatcacttctagtagcactaacaacctttagtttccaggacataatattatcctgcctccaacatctctggatgcttctcagtttctagctatccatctgcttctgggcaaccattgaatattggattccatgagaatctctatactctctcccaagatgatcttatccatacttaacagctttaattgtcagctaaacactgagatcccgtaaatctgtatttttaggtccttgtctgtgttcttaactctatgtatcttcttttcattgttcaaatgcatccccaactccaggtctactgaataaattcaggacctctactctgcaacctaattgtcttatgtgtctctatagttggcaccactgttcatccttgacacttttcttccaccatgccccaccccacccaacccatccgtaagtgctgttgattttcctgtttatggtggttgaatccagccctgtctctccatctttattgccacccacttagccagtgctagatcccatcacttgtcaattgggctcccaacaacagccttgtaagtagtcccatgcatccactcctgtccctcctgcaacctcagtttattctctacttgctgtactaggaacaaactgtcactcaccagcttaaaactctttgatgaattactggtgctacagactaaagaacaagattctgactacagccaaaaaggccctgtttgatctggatcctgtctacctatctagcttcaactctgtcctccatgcttcccctcattccatattgtggccacacttctttcagtctgtgtactgttcctttctgcctcagggtttttacacataatattccatttgcttgcatttcctactccttattccaggtaacagctccatattttcagatcttatcttaagtgactattcttcggagaagttctccctgactccctagtagataagtttgcctgcctgtcttatgtgctgcatattttccaagatggctgtaacaataccttccatccattatgctcttcttaacagtgtgacattgacactcctcctatgaaggaaactccatatttcttcctcttaaggtggctatgtgactgtcagaagtgacactgtgtgacttctaaagctaggtcataaaaggtaatgtagctttggcctggtcttttctttgagatgctgactattggaagccagcaaccacactgggatgaagccacatggaggggtcattgagatctcagtcaacagctagcatcaactgctgacatgacagttaggaagccttcaaggttacttcaaccccagtcactgttgaactgcaaatacatgaaacaccctaagtgagaaatgcccagctgagccacgttaaccttagacctatgagatataataagaaataatagttgttgttttgagccaataaattttgagatgattcattatgaagcaacaatagataactgaaacatgtactttatagcatgtatctagttgaacaacttgtttgaaaccatataacatttgtctatttatgtaaagtatttgaataatatatatattcccagatagactttaaatctctttgacacaggaacggtgtctgatttgctcatcactgtatttatagcactagcaaagagcacatggtgggtactcaaaaaacactttttgagtaaattaataaatgaatgaattcctattgttgggacaagtttgtaaaactttcccatatgaaagtttgaattttcccatatgaaagcttgaattaacacttcaatttatctaattgtgtaacctcttaaggcttatttgatgtgacatttctcactaaaaaattaatgactcaaagcacagtgaatgatgattctcattaattcatcaaacatttgttgaccatgtgcaaagtcactttgggaataccaagagttatcacagggtttcttcactccagttgctcacacatggaatgcttcaagaatttaccagagaccattggcatttaagaattccacattttctgttgctatgatctgaatgtttgtgttcccccaaaattcatatgttgaaatcctaacctttaaggcgatggtattaagggatgaagccttttgtaggtaatttagatcatgagagtggagccctcatgaatgaaattagtggccttataaaagaggccctgaaagagaaccctttcttctctcaccatctgagaatgtagcgagaagttgccatctatgaatcagaaaccaagccctcaccagacacagaatctgctggtgccttgatcctggacttccccgcctccagagctgtgaaaaataaatttctgttgtttataaaatatccagtttatggtattttgttatagcagccctaatggactaagacgtgtgtttatttttgtgtgtatgagaaatgactgagtaattttctgtctgttcagcgttcttaaaatgattgagcctctgtgtcttcgtggcagttgtagtgtggtcacatccaggaatcacttgactgtactgaaatgtgattagagaaaaggctgggaatacatacagaaatatctacctatgatgtcttagtagttttgaaggactttgtgaatgccggacatcatctgttggctgacactatgggtggtatggtaaatgagaagttaaagtggactgcagggctcagaaaagctattatggaggtggtgaggcttaaggcagggtttgaagaatgaaagcagagacagcaatgtaagatagagcagaatggtcatgtaggagaatagtgagagaggcagctggaaagaaaaattggagctaagttacctggatctttgatgatcaggctaaaatctacttgattctgaagcctagaacctataggtgagtgattctccaggagaatgcaatatggcttcctgggttgtcaaaaacacatgcttctggagagcctaatttgcactgtcctacctggggtgcccttctccttctttcctgcttttctaagatcccttctgtattgaaatagtaagcaacacgcccttgtgactgatgagcatatgttgtttctctgggtgggttatatcaaaaagaaaataaaacaaaaagattgaaattatgtataatatgatctgtgggtatccacggagatttttttaaaacataaaagcgatatgagtaaaacagtctctggagaagatgaccatcgcagtggttgcaatgagcaagaaggaaaatcttgaggcaggaagttgatgcctcagacaatgttggttgtcaacccaacattcattgcctgctttttcactgctagcagagacccagttttgatcagttcccctccttgctctacaagaattaggggagcttgactccattcccagctctaggggaaaagcggtacttggtgtaagccaatcatgacagtcctgttcctcctaccaagaatcaaattaggagtgtgcatgtggcacagtaggacactgagatgtaaggggggcctgtgaaaggtatcttcacttcttgttgcatatcgggttctctgaaaaaacagactctgagaaggcaatgagcatgcgggaatttcatgagggagtgcatttgagattgatgcctgtgggaggaaagagaagacagcaggagtgggtgagagagactttcagctgtgatgtagtttcagtgaatgcctcagccagcccaacaaagaactctaaggatggtcctgcggagtcgttctgagctgaggtgaggaagctggacctttatgtactggtgacaaacagttattggatattggctgctcccaggaagggaaagtgaatttcagcaaggcaagtatcttcagtaaagggcatttccaaaaaggactgacagctgcaggctctctgctaaaaacacctccagcagctgagagaataggtccttcaatcctaaagaggaatataggtagcacatttcagcatccactatactcctaaaataatcatacagacaagagaaagtccctcttgttccactgacattatgcatgaatgtatgcctggaatacaatagccatttcacaaccagactgagactggagtcaacacaggaagatgaggagaatgaagagaacgacaagagaaatagaaccagagcctgtatccatgttgcctggagcctacctggggttctggactccttcatataggtggtaaaaatgttgttactgtttgcatcagttgagttaggcttttctcttacttgaaccccaagcatcctagccaaggatggatacttcaggcaacagacgataaggcttgaaaaacatacaaagaatgggaaagaaggcacaggtacaagaaatattgcaaagaaagcatcagtaaaacctaaggcctggcactatgaggtacaatggtgacttcatttttataatagtcacaaacttccttgtttttggaatggccaaatgaattaaatgatggaatcaatattctggcaaatattttaagtggttgatgtggtctgtttgtgttttgtgatagcccagaacaaatcgtacctcaatttctttctggggaactacctttccctattgtgaaaaatctagtggaatgggaaatccagatgtctccccgtccaactatgaaagcccaagagtttcaggaagtagcatccacctgattcttctttatttccctgatatagtgtaaggcaggcaccttttcttggccatcttgaccttgaattagaagaagagacagaataagtgacaaaatggttgtatttttaaaaatttcaatagcagcaccctgactgttcctacaatgcctatttcccagtgctccacccctgcccactcaaagctgcccctcttttgcctgcttccaaaccttttcttctgccttcctgtcaacattgcatactcctgaaatcctgctcacgtttcaccaatatccagtctctctttaataatacaacccctgagctttagctaggcacatgaattcccagctcagggtatttcaccctcccttgcaatttgatatagtcctaagactaagttctgtcacggaatgtaagtggaagtaatgtatgctaacttccaagttgttccttgataatggaaggttcacatgctatcctgagcctctccctttaatcttggctaggagatgaaaactgggcagccatcttgaaccatgaaatggaagcatgttgaggattgcagagtggcttcactagtcttggattgcacatttctggactgtgatctgagaaagaaacatgtaccctgaatcagccaatctacagtgggtctctgtcacagcatcttggcatctaccctgaataatataacttctaataagttcttaatttttgaacaaacttatctgacatgcctaatcaattagtgttaataatatgaaaatattaacaaaattaaaactttagggggttttgtagttcaaatattggcagacatgaaatatttaaatgattccgtagccaagagaagctgtgcagacactggaatatttatagtgtaagacagtaagaatcgtggtatttgtgtttccataacactgaggaaccatttccaccttggatccaatctagaaattatttttttcctgccaaagcctaacttggataaaatcctctccttcacaaatgtgaagcagaagccataggaggagaaaactgagtttccatagaacagaggacagagacacagcacagagaataagattttatttccagagttgtacaataaaagcaatgggatttttgtagaatgttggaggagatgaactagcctagtaatatagttgctacatctcaaaactttaaagtaatttttgagcagttactcatgtagacagttttctatacattttcagaaagaccctacagcgtagacatttactgaccaccaaatacctatgtgcttctctacgttttctagccttcttgcaattaggtagaaccatatggctggttatggctgtgaaaagtgtgatatattgttcctaagcttaagcatttaagagccaacatatgtagttaaaacctcccacaaagaaaaccccaggcccagttgacttcactagtgaattctacctaacatttaagggagaaatcataccaattctcataaaaccttagagaaaattgaagaggagggaatatgttcctatgtagtctatgaggccagaattactctgatagcaaaaccagacaaagactacaaaaaaagaaaactacagcccaattttcctcttgaacatagatgtaaaaattctttaaattttagtaaattgaatcaagcaatatataacacaaaaagtataatatatcacaaccaagtagagtttatcctaggaatacaaagtagttttaacattcaaaattcaatcaatgtaatttatcacattaacagatcaaaaaagaaaaataatattatcatcttgatagatgcagagaaagcatttgacaaaaattcaacatctattcgtggtaaaagctttccacaaactaagactggaaggaaacttcctcaaaccattaaagaacgtttcaaaataaccgcagttaatatcatacttaatggtgaaggtagaatacttttcccctaaggatgtgtgctcttgccacttctattcaatattttactggaagttctagtcaatgaaatcaggccagaagagaaaataaaatatattcagattaggaagaaaaaaatgaaactgtctattcaaagatggcatgattgtctatataggaaatccaggttgggtgcagtggctcatgcctataatcccagcagttttggaggccaaggcaggaggatcacttgaggccaggagtctgagaccagcctgggcaacatggcgagaccctgtctattaaaaaaatccaaatccaatagaatttacaaaaagttgttagaactaataagtaagttatatataccatttactatacaagcaatcagaattgaaatttttaaagtaatgctatttgcaatagcattaaaaatatgagagatctgtagataaatctggcaaaagctgtgcatgacctgtatactacaaacattaaaatattgagaaaaattaaatttcatggatctgaagactcaatatttttaagatgtcaagtctccctgaactgatctttacattcaactcagtccaaatcaaaatctcagtagacttttgtcatggaaattgacagacaaattctaaaatgaatattgaaatgcaaagaactagagcagcaaaaaccactttgaaaaagaaaaataaatttggagaaataacactccctgacttcaagatttattaaaaagctatgttaatgaagataatgtggtgttggcataaaggtagacaaacagatcaatgaaacagaagagaaagtccagaaatagacccatgcatataagatcaattaaattctgacaaaggtgccaaggcaatacagtggcaaaaagatagtattatcaacaaatgataatgtaaccatcacacatctatatgccaataaaaagagcactttgatccacgtctagaagaaaacacaagaaatctttgtgatcttggactaggcaaagctttcctagatatgacaccaaaagcacaatctataaaagaggaaaataatgtgaaatgaacttcatcaaaatgaaaaaggtatgcttctcaaatgatgatgttaacaaactaaaagacgagccacaggtgaagagaaaatatttgtaaattatatgttcagaatatatgaagaactccaaaatcaatcataagaaaataaataagcacccaaaatttggaatagacacttcacaaaagtagatatacggatgacaaataagcacaaaaagatgctcaacatcattagggaaattccagttaaaaccataatgtgatattactacatacctatgagaatggttgaaatttaaaaggctggttatatataccaaatgttggggaaaatatgaagaaattaaattctcattccctgctggtaggaatatcaaatggtacaaagacttggaaaatagttaggcagtttatttaaaagttaaccatacacctatcatatgagccaaatcagaattatgctgaatgaatgaaggcaaaacaaagggtacctactgttattattcgaattctataaattgtagacaaattaatgtatagtgagaaaacattagtgatagcctgggggaggggatggagaagggcggaaagagaagttacaagggggtataaacaaactttgggggtgatggatatgttcattatattgaatgtggtaatggtatatatacatgttaaaatttgtcaaactgtacactttaaatatatgcaggttattgtatttcaattatacttcagtaaaaccattttgtcaaaagtgctgtaaggtgaagatcagattaagggtgtagccctcaataaaatctcttacttgtacaaaattactcaggaaaaaaaatgtaattaagatgatggccttctctgccctcttctagattctttcattattaaatcaatagagagagaaagatgtgggatttacaaaacagcaaaaagtgtgccagatctgttaattatgtcctcaaaagaactatgggtgtggctgttacatggcattgactacaatcatattttaagaagtctaataaggctttattaagtttatttttaaagtgtcaaattcagtggttttagtatagtcacaaagttgtacaaccaatatcgctaattccagagcagtttcatcagccccaaaagacacatcatacctaattagcactcacttttcattcctccctcctgctaacccctggaaactagtctactttctgtctctatggatttgcctatttcggatatttcatgtaaattgtattatataaaacatggtctttcgcatttgtcttctgtcatttagcataatgtttttaagggtcatccgtgttgtagcatgtgtcactgcttcattcctttttatggataaataatattccattacataggtgtgccatttttattaatcagtttacccattgttcagtctaacaagtttttaagagtcttgtggctgggcgcggtggctcaggcctgtaatcccatcattttggaagacagaggagggtggatcatttgaggtcaggagttcgagcccagcctagctaacatggtgaaaccctgtctctactaaaaatacaaaaattagcctagaagtagtggcacgagcctgtaatcctacctactcgggaggctgagacaggagaatcgcttgagcctgggaggtggaggttgcggtgagcccagatcaggccactgcactccagtctgggcaagagagtgagaccctgtctcaaaaaaaaaaaaaaaaaagtctcgtactgctagagaagccacaagtctgggcaataacaaatggaataaaataagacgactattcaagccttaaaatcctccaaggaccttgagtatatacaacctttatttaatcaatcaaatttttttttaatgaaataaaccatctttgggtccccagtcttctaagggcagcagacaacactagatagactcaaggagggcatatatgttcttcaataactactttagttatggcaagaagcggaatagaaaaaggagagctgctagagggcaggccagggaccaccaagaacaatggacaagagagtttcttccagagagaaaatcagggcctgattcagaatgttcttcactctcaggataggggcctccactcacacagagcagttttggaactgctacatccagtaactgctgtgtgtctctttctttccctttccaaatgagaatgtttatttccaccattatatgttaggtgtgtgttggaaggggaggccagacaattcgttgttttcattaggcttttggaccaagaagaaccaggactggtccagaggtgaaggctatcgtgcattgcccagagatgcagaattataagctatattaatagattacatgggactttgggtggcctcccttggggaatggtggagggtattctatacatgggaatgtatttagatcaggaggaaatttccttttggctaaaggcaactttccagaagaggaagcagctgtgagccactggccaacattaacagcagctgggagatgtgtgcacctgcctggtgaaagtcatcaaggtgggggcaccaatagcatctactacagggtgaatggaagcaaggggatatttggtaaacagaagtgtggaccgtggcagaggcatctagtgcacattgaatatccatgtgtttctccacatttccaagccctctttacaaataaatggggtcatgtggccaaagtgcttgaagaagtaaaatttgtcacttttgaggcaaagcatttaagagtctcctagttcttctcttttcctgcctcagcaatcatgaagctcaaatgttaagatatcagtgtcggcgtggtggctcacgcctgtaatcccagcactttgggagaccgaagcgcgtggatcacctgaggtcaggagttcaagaccagcttggctaatatggccaaccctggtctctactaaaaatataaaaattagcaaggtacagtggagcatgcctgtaatcccagctactcaggaggctgaggcaggagaatcgcttgaacctggggagtagaggttgcagtgtcgcctgggcgacaaagcaagactccatctcaaaaaacaaacaaacaaacaaaaacaaagatatcagcgtctccatcagcctgtgtcgctatgtggaacagagctacccccaaagctcaccttgttggctcacattgaacttatatcctgagctcagaataaacctttgttgtgttaagccgcttgtttgcatgtttatttgttatattatgaattggtttatccattcaagtttgattaggaaagcagagatactgtaagtgatatggaattttgaatttatgataaggattactttaagatgtcaagtctccctgaactgatctttacattcaactcagtccaaatcaaaatctcagtaggcttttgtcatggaaattaacagacaaattctaaaatgaatattgaaatgcaaagaactagagcagcaaaaaccactttgaaaaagaaaataaatgtggagaaataacgctccctgacttcaagatttattaaaaagctatgttaatgaagataatgtggtgttggcataaaggtagacaaacagatcaatgaaacagaagagaaagtccagaaatagacccacgcatataagatcaattaatttctgacaaaggagttgtggaagctggtgaggaaccatatagaaagctgttgtccattgagtacacaaagaaggaaacaatagatacagggacctccttgagggtgaagggtgggaggagagtgagggttgaaaaactacgtatcaggtactattctcactacctgggtaacaaaattatctgtacaccaaacccccaacatgcaatttacccacgtaaaaaacctgcagtgtaccccctgaacctaaaatagaaattgaaaataaatacattaataactaataaataaaatcatagccaaaaaaaaagagttgtggcctctgcatacaatgatgagtgtgaagtcactgtaggtagcagggccagaaatcagaaagaaaagttgaatataaagtgggagaaagcaaggccaaactggagcccataaggacaaactggaaaccatccattactgactgtctccagtttcaatgatgtgcgtgacctgcagaagttgacatcttttgccacggagctgcatatgcatctggctcagaacttaaagaaactgaaggaggtcaggaaggaggcaaagaatctgtgggcccagctcttgtcccatatcaacaaagtgacccagcatatctgcagcaatatgtacagcctgcaggattgcctggctccttacactgagctgcagagaataatgggtactacttcacctttaccttctaaattctcttgtggcccaccacaaaagagaaccacacagggaaagaaattctgagaaacacagttccaagttagctaagttgacctacaaagccactacacgtagcctaacgtaatacagactcagaaaagtgatggcagggttatacccagaacttgagtaacacaacaaagtaagaaaaaatcaaagtgaagacaattctctcagccacacttggctaaagatattcatcaattcatagagaaaaaattaaaaaataaatgtaggaaatcaaataattatagttaatgctgcacacaatttaaagtatagtgattaagagcacagattttgtaaagtcaaaaatccacttacaagctgtatgatcttacacagttacttttttttctctgtgactcatttctaaatctataaaatggggatagtaaaacttttctcatagggttgttgtgaagattaaaagagttaataaaaataaagcccatgtaactgtgtttggtgcataagtgtttattaaatgttaatattttcactattatgtataaccatgctttaactttatataagatacacacttataatgctcggtaaatttctaggttgtctttatgaagttccaggtgaaaagtttcctccatgtgttatggcagatagctacttggaatggggacccctacctgagagttgtaggcaagatgctgttgtccagaatggggaaaaccaagtctgtagtctctcttgcagaatacttcccttgcaaaaagatgtctgatataatctatagctcagtaacatgaattattatcacttatatattaagttggtgcaaaagtaactgcggttttgccgttaaaagtaattgcaaagccgcaattacttttgcactgaccttatgtgcatatatgtttacgtgtgtcattgacatgggacttctgacctagatcaatgatatattcacattctgtgaataattagagagaaagcagagaccatctacttaaaaaaatagacttctaaaatttttcctgtgtcttctgttaaggcatcctcttaggtaaataaagccaaggtattcaagcaagtacaattgtggtttatcagactcaattctagatctggtgataattctcactagaacatctgtatgtatttgtgtgtatgtgtctgtgcatgagaggctattatcaaatcagagtttgtattagtagatgttcacagccaatttggttgattgtattttgttaacaggtatgactgggcttttccaatttctcttatcaaaaagagaaaaggtattcagtgacaagtaaaaaaaatcatagagatggttaggtgtagtggctcacacctgtaatcccagaactttgggaggcagaggcaggaggatcacttgaggctaggagttcaagatcagcctgggcaacatggcaagactgccgactctacaaaaaaaaaaaaaaaaaattagcagtagctgtgactatgggaatgtgccaccatgctcagtttactcagcaggaggattgcctgagcccgggaatttgaagctgcagtgatctacgactgcttctttgcactctagcctgggcaacacagcaaaacccgtctctttaaaaaatcatagagttgcattcattgagacttatgtctgcgttcttttcaaggtctctagggtagtgagtgggctctccctgatggtcatggttgattccgtgccatcagccttcttgtgtctaggggacccatatggaaaaaagttacccacattcctctctctctgaccatgctgttcaacttaaaccagatcaatgtagatttttttaaactgaaggatgtgtggcaaataattctgtttaataagagaatcctgatttttagctaggcatattgcttctaagaataaaggactacattttctggcttaccttgttgtagaaatgtgatcaagttctggccaatgggattaagtggaggtggtgtatgcaacctttgggaaggctgtttaaaggagctaactcagtggagggctttttgcttttcttccctgttctttcctaggtggaatacagatataatggctgagctccagcattcaccctgggatgtgggatgacctaaaggacagaagttacatggtaagaatggctgggcaaaaagttgggatgatcatagattcctgatgactttgtgaagttgtcataccaattgtcgtctgtatacctatgagcttgttttatgcaagagaataaactattgtgtttttagccactgtattcaagtctctgttacaactagctgaatacaattattaatacaatcaggaagtcctggaaggtttttagaaacatttttctttgccagaatggtatctcctgtggatcctccttcagttccaaatctagtttcccacctcaggttggtgacaactgcccaaattcaaatgaccattgaattctcccccatatgattgcctcattcctttctacaggaggaacttcaccctggggttccttaaagcattaagcagtgtctttgatttcagccaataggcctggacagagactagctggtggctccagcacaatcctggttttataaatgatgataatgtgcatcatccattctagtttacacatcctatcagtgacaactgcagagttgatggcccatttaactatgacaccaactgtgtcatgtcagtttaggtcctctggaaagcagatgccaatatggagttagatgtacaggagatacattaagagtaacacatgtaaatgataaagaggaaggtgaaatcccatagattttccagatataagtggtggacttagtttgttatagatggggaaaaccccagctttgcttgttccccaaggctgaggtcctggttcgaggtgaatggtgattacagccagatatttaacgggaagagtctggaagtcagagaaccatagaagtgctgagataagctctctatacttccctggtggatggccaaactaaacacatgggagagacccaaaagatcctggggaaaagtgaaagccaagggaaacatgaaaactggctgcaactttgaatacattttttaaccacacacagttcaatcagcagagggtagaagccttataagctcaaactgtttcaacacaacctcagccaaattgattggcaataactaagctattcagagatgggggcaatctttagaaagttgggctgaaatgttaaaataagaattaaaaatgtgagcagagacatcagtggctgcatactaggagtgaggtgagtgaagcagattctgcagtttaagttcagaaaaggtattaaacaccaaacaagcaaaataaacaaaaaggcttcagaaaaataaaacaatcgagaattattacaatatattctataaaatgttatctgaagtgttcaattttctttttttctctcttttttttaaatactgctccttgcagagcagggttaccctataggcagtgtgccgagagtagcctgaagtgttcaattctcaactaaaaattgatagacatataaagaaactggaaagtgtaacctaaactcagagggaaaagtagtcaatagacactgactctgattgaactcaaatgttggatttagcagagactgccttcaaagcaggtattataaatttgtcaaagaaattaaagaaaactatgtttgataaattaaaaggaaatatgttaatagtgagttaacaaatagagaatcttaatagtgaaataaaaaaactaattctagagttaaaaaagcacaataactgaaatgaaattttttattttttattttactttaatttctgggatacatgtgcagaatgtgcagatttgttacacaggtatacgtgtgccatggtggtttgctgcatctatcaacccattatctaggttttaagccctgcatgaattaggtatttgtcttaatgctctccttcccccaccccccgacaggcccctgtgcgttttgttcccctccctgtgtccatgtgttctcattgttcaactcccacttatgagtgagaacatgcggcatttggttttctgttcctgtgttagtctgctgaggatgatggcttctggcttcatccatgtccccgcaaaggacaggatctcattcctttttatggctgaatagtattccatggtgtatatgtaccacattttctttatccagtctatcattgatgggcatttgggttggttccatgtctttgctcttgtaaatagtgctgtaataaacatacatgtgcatgtgtctttatagtagaatgatttatattcctttgggtatatacccagtaatgggattgctggtatttctggttctagatccttgaggaatcaccactctgtcttccacaatgtaaattaagctagtttacattcccaccaacagtgtaaaagcattcctatttctccacagcctcgccagcatctattgtttcttgactttttagtaatcaccattctgactggcatgagatcgtgtctcattgtggttttgatttgcatttctctaatgatcagtgatgttgagctttttttcacatgtttgttggctgaataaatgtcttcttttgagaaatgtctgttcatatcctttgcccactttttgatgggtttgtttttcttgtaaatttgtttaagttcctcatagattctggatattagacctttatcaaatgggtagattgcaaaaattttctcccattctgtaggttgcctgttcattctgatgatagtttctttgctgtgtagaagctctttagcttaattagatcccatttgtcaattttagcttttgttgcaattgcttttggcattttcatcatgaaatctctgcccacacctatgtcctgaatgatattgcctaggctttcttctagggtttttatggtttggggttttacatttaagtccttaatccatcttgagttaatttttgtataagacataaggaaggggtccagtttcagttttctgcatatggctagccaattttcccagtaccatttattaaatagggaatcctttccccattgcatcttttttgttgggtttgttgaagatcagatgattgtagatgtgtggtgttatttctgaggtctctgttctgttccattggcctatatgtctgttttggttactgcagccttgtagtatagtttgaagtcaggtagtatgatgcctccagttttgttatttttacttaggattgtcttggctatgtgggctcttttttggttccatatgaaatttaaagtggtttttttctaattctgtgaagaatgtcaatggtagtttgatgggaatagcattgaatctataaattgctttgggcagtatggccatttacacaatattgattcttcctatctacgaggatggaaagtttttccatttgtttgtgtcgtctcttatttccttgagcagtggtttgtagttctccttgaagaggtccttcacgtcacttgttagctgtaatactaggtattttattatctttgtagcagttgtgaatagttcattcattcgtgatttggctctctgcttgtctgctgttggtgtataggaatgcttgtgatttttgcacattgattttgtatcctgagacttggctgaagttgcttatcagcttaaggattttttgggctgagacgatgggattttctaaatatagaatcatgttgtctgcaaacagagacaatttgacttcctctattcctatttgaatatcttttatttctttccctgcctcattgtcctggccagaacttccaatactatgttgaatacgagtggtgagagagggcattcttgtaatgaaaattttaacaaagctgtttaacatgtcagtttggtcaatttatttgagccccattttatttttttggcagctgtaaagagtaaattacttaatcaatgacacactgttgatctctgaaacagagactattcataaaaggcagagaaaataattattttcaaatgttattatgtttctgcttcctttctaaaaagttttttgtggttaacaactaagtgttgaaacatgagccaggtgcggtggctcacccctgtaatcccagcactttgggaggccgaggccagtggatcacctgaggtcaggagtttgagaccagcttggccaacatggtgaaaccccatctctactaaaaatacaaaaaaaattgctgggtgtggtggcagttgcctgtaatcccagctactcaggaggctgaggcagaagaatcacttgaacctgggaggtggaggttgcagtgagccgagatcaagatggtgccattgcactctagtctgggcaaaaagagtgaaactctgtctcaaaaaaaagaaaaagaaacataaaaactatttgccaactccattgagccttacacaaatacaagaacaatgtttccttcagttgtttttggaaggtcatatttttactctggaattattattgataacataattcatattattttcagctacttggtcatggcaggcagttgctttaagcaaagtgtactatgcttgctttaaaaaaccaagtttcttcagctttttcagctgtgctcaaatgcaaatagttcagagggaggtccatgtttctctgtgttgtttggatttccatttctttcaaccttggccatttcaatcccttcaaggtctctttttaatgtgtcctatggtttacttgatgtctaatttctcccaacccctcacatttctcttttatggttatttcccttggtatcggataccaaccctgaggaaagtgctctgctaggtctcaagaatgcaaaatttacatcatgggggaattttagagaataagtaacatataggcatgtaaattatacacccactgtctagttgatatcaattttatcagtttacacatgtaccttcttactcctttccgcattgcttcacccacacactgtctgagccctgtgtcttatatttcaatccttgatgaaagtaaactttgctggttttataaatatgaaatcctgtcactaagaagtcataatcttatagtcctgacactgaccccatgctgaagactggggtgtagtcttttggagcatttctcttctgactcctgaaatcactgacttggatatattcgtggccagagtaatccctttgctaatgattgtgaaaaatgactaaaatatcacccaaatataatgctctattcaggttctcaggaaggaggcataaaatcttttgcaagtcatctaatcttggaaacaaaacttgctttcaaataaattcaaacatagtctgttacagccttagggaacaaacagaatgcattgattattccatttatttgatgtttaggcccatctaagaaaatggtgataaattcatgccttagtaaatcgtagacaatttccattattctgtttcctcctctacctatgccttcccacacatacccactgcaaatgttgctgccaccactatcctaacagccaaagaatcattttttgtagcactaaagtggagcatgaagaatgggataaagggtattccatgtgtgtgccgttttcttggagtagctctgtgatacccatcccactgcccacatccaatttactgtatgtgataagacttggagtacacatgttacggttagggataatatttgtacatactgtaataatgaatgtgcactgcgtggatttttttggagtccacactattatcagtgtgggaggtggagagaaaacacatgtgtttggatcttcactgtatactctggagaaggggaagagctgatgaacaaagtatggagaacaaaatcattcactcgggtacaagagaaacaatcggggtgatgttagcaagtccttgtgatcagaagcaagaatggagagggaggcttctaaagcccaaaagattttaaaaagagagttatagctatggcaccagtctttgaatatacaggaagaccaaatcctgggctattagaggtcaaatggaggaaacttactgggaatgagaagggaaagggtcaaagagtcttgccaagttgtgtcatcatatgaagctagagtgtacttatattagcgaaagggaatttgggactcagttaagctcttttacatatttttctagtattcttaggactacacatgtagtgaatttttataatatgttgtctcagcatcattttgaatatattggactttctcataccagaagcagggcttagtcacccttgacacagtttcctgttctccatctcctccctgttccttaatgtggtcgatccagatatctaccttatacagtcacctgctggtgaccacctccctatgggacagctagatacaacctacttgactggccccactgaccccccacactctacatgggccgcacggatctgccacagcgaccccttctcagtcacagcgtgcctccatggaactcctgcctgctggctttcaacccaccgatgagaactccccacgggaaagcggcctgggaatgcctggaccccgataaaggcctaggcccacaggtccctcactctctatcttgctccccacctgctggctaagcatggatggcccagagggttccttccttcttgctggccctgagaggaatctgtaaagaagatgctgcctctggtatttcacacgttctgtggagctgcctctctgtgtctcaccccacccacacacccggacctaacttctttcccggttggcgttctcctagagagtggccctcttggcaggaatagactcgacacaggtcagacaagagccacaagggcgcctgcgactataaacaactttcctgtgagagggacacctggtcatgggttgagcacttaggaatgaggctgtctgccaggataaagaagtgtcccgaggccccgtccccgcttccggggcgctcgcgctcctcctctccgccccctcgctgtgggctcgcgcagtgagggtcatggtgacctggggggcatggggccggcgagctccgggaggttcgcatcctcggggactgggagcccagttatcggacccaggcgaggcccccagcttatgacccgcccccatcgccgtgatcctcggggccggggacccccgactccacgcgaccgtgaccacatccaggtcccccaaaaacacacacacgtcccttctgacctgatgattccactcccatcatctcagagactgtccagcgcccccctcccccggcttgggagcttgtcatgccagtgcagcagacaatccatgtacacacgcacgtctggcctggggacacctgaggtcacctgaccacatagaacccctccccatctcttctgacccgaggattctcccgctcgctctccctgtgacagtgtctggcgaggggtaggggggttgtcccttttccccaacctggcaatgaccttggcattgggctcagcagacccgccttccacatgcaccaggccccctcaaacccctgtgaccagtttcactgccaccatcttggtgagtgtgtgtctgacctctccagaaatgcacatcgacccccagtcagcccggcgactttgtcacctgtgctcaagtgatgtctccccttcccttcacacccacctgacctggggacatctgaggccaatgtgactctatctaggcctgccccctagcccccagcacatgtacacctgctttctgatcagtcccaccatctcggtacctacctccctgacatcttgtcatcctagatcagcacctctcccgctccacacacgcctggcctggcaacgctgtgaccacatgtagtctcctggctttttccctgaagagcctggtctctaaatcctctgggctggaaggaatcagattttcaaaccctgtgaacaccacccctgacccacgatcctttttgtgtctttcttgacccagtaaaatgctctcatgtaaaaaaataaaataaaataaaataaaaaataaaataaaataaaaagtggtgtcccatgaaaagcagtttgtaagcttccccgggagttctgtcagggcagggctaaaatttatagccactccccagagagattcctgaagactgaattagaggaaaatcaaaacacatttatgctttggagaaaacttgactgttttatgctgtttgaattgtcttctaaaaatgagttttaaattataaaaagtattaaaataaatatgtcatattccttcactcagttaattgtgaaagcacatggattgactcttcactggcacatatagtaggtatattccattgtggtagtttccttgtttttctgggatcacaactagcctacactttccagtttcccttgtagtaagttgggcacatgtcatcgaacgccagtggaatgtgagcagagtgatacatgccactttcaggcctggaaaatgccaaggctcaaggaaaatgctaaagccatcagatgatagatgctaaggtccctgaatgtgtggagcaaagccaactactcacccttagtgtactatcatgtgaacaagaaataaacatttatcatgtttaataactcataattggagtgtctttgttatagcagttaaactcccaggctaatacagccagtgactttcagagaatataacctggaaatttctgctaattattactagaagcttatttgtgacaaataacattctgaaggtgtatagtaatttgtaagttcagatcagttattctcaattcttagtgttgtgtcagaattacctaggaagctattttaaaagatacatatcccaaaagactagccttgacctagcgaatcagaagtagataagacataggcagttatatttgaaaaacttccttgtgttttacatatacccttggctaggaaccactactctaagataacccaaattttatctttagatgaagccagattatctgacctcattgttttggggccatataatttattttcctggattgggttgttttaaagtatagtttgattgtacttaaaaaattaacatgtaataacactgatctttttgtgtaaacagttctacagttttataaattttacacatttaaagtttcatgctttatcacaaaaattaggacacaaaccattccatcatttcaaaacactacctcataatacccatttgaattcacacccttaaccccttgaaaccactgatctgttatccatcattaacagttttgtgttttcgagactctcatagaaatgaaatcatacagtaggtaaactgttgagactggtttctttcactcagcatagtgcttttgagatttattcaagttgctgcagatatcaacaatttatttcttttaaggctaagtagcattccattatacagacctaatacagtttgctttccaattactattgaaagatatttgtgttgtttccaggtgttggagattgtgaatagagcttctataaaacatttgaatacaagtttttgtgtgaacctaagttttcctttcttgagggcagggctttttaacttcagcattattaacactttggaatggaaaattcgttttcagggttatcctgtgcattgtaggatatagtatcgctggcctctactcactacatgccagtagcattctcctcgccacctccccactccaagttgtgacaaccaaatatgtctccagacattgtcaaacgtccgctggggtggggagagggaaaatctccctggttgaggaatactgccttaaaggaattgaaacatctaatattactttagtgtgagactgctagtgacaaatatcaccttttgtctttaaaatttttatgatacatatttgtacatatttatgagatacgtgtggtattttattacatgcctagaacgtgtaatgatcaagtcagatttaggggatctatcaccttaagtatttatcatttctatgtgttggaaacatttcaagtcctcccttctaacgatactgaaatatacaatacattgttgttaattatatagtcaccctactctactattgaatattagaacttgttccttctatctatatgtttgtacatcttatgtctatatgtttgtacccattaaccaacctctcttcatcctcgttccatgcacctgtcccagcttctggtaacaatcactcgactttctatctctatgaaatcaacacttttagttcccacacgagtgagaatatgtgaaatttgtctttctgtgcctagcttatttcacttaacataatgacctccagttctatccatgttgctgcaaataacaggatctcatcctttttggtggataaataatattacattgtgtatatatacaccacattttatctattcatctgttaataaacatttaggttgatttcatatctttgctattgtaaatagtgctgcaataaacatgggggtgcaggtatccctttgaaatatcaccttttgttttaaaatgtctctgctacctacatttctgaaataaattttctctggatccgaaattctaatttggcagttttttttttttgacagggtctcactctgttgcccaggctggagtacagtggcatgatcttggctcactgcagccttgacctcccaggcccaagcgatcctctcacttcagcctcccaagtagctgggactacaaaagcacaccaccacacctggctagtttttgtattttttttgtagagatgggtttttgccatgttgcccaggctggtctcgaactcctgggctcaagtgatcctcctgctttggcctcccaaagtgttaggattacaggcatgagccaccacacatggcctgttttctttcattacattaaaaaataattacattaccttttggctttcacagtttctgttgagaagtcagttatgtcttcatagtgttcctttaaatatgccattcttcctgacagctttcaatatttttatgtttggtggtgctgtggtcacctcacagaggtgaaatggattttccccccaacacaagatttacttatgatgatgtcacatacgcatccagaaggtatgaaaatgtttattacatacataatgagtcttactggggaaagcaggcatgcacgcatcctaagctggtcgaaaaatgtcttgagaaaatagagaagactggcttgggatttttatggtagttgaggggtggggctgggataaaggttcccacatgcaggctgaggcttgagtgttttgaacttccagctactaccaaaggagggagcacctgagctttcttgttagcttgcccagatgtagggcagagggaaacggaggagtgggcttaaaagttgtcaacgaacatcaccaatggagtcacactctagtacaggtgttaagtaattttattatgaattagtgttgttttatatttttcttgcttggggtttttagtgcctcttgagtctttgggctgtggcctttcattctgaaaagttctcagaaatttttcttcaactattgcttttgttctattctctcttctctttttgggattctaattacacatatatttgaccttgtcatactactacaaatatctcaacaactatcttttgtattttgcatcattttgtctctcacatcatattttcttctggactctttcagtttactttctttccatcaatgtatcagtaaatccacacactgatgtcttaattttactgtttgtatttagttctagaatttaaaattcattatttttttcacagcttccattttctactaaaatcctcactcttttgtattaattccttgaaaatattaaacttcagaaacaaccaatacctcttggtgaaaaacagccccatgtgccaagcacatctatttgggcttcatttctctcccaaattttgacctcataattcttattttatttatttttttagacagagtctcgctctgttgctcaggttggagtgcagtggctcgatctcggttcactgcaacctccgcctctcaggttcaggcgattctcttgcctcagcttcccaattagctgggattgcaggcgcatgccaccacacttggctaatttttttgtatttttaatagagacggggtttcaccatgttggccagactggtctcgaactcctgacctcaggtgatctgaacctcataattctttactgtcctgatagcattcagatactttcaaatttgttttaatatatatactttagtccaaattttctatctgttcccagtggtaggatggtctgagtcacttactgggaattactagaaacctagacacttgcttttaaatgcatgattacattttacaagacaactgtccctgtttgtaaaatgtcaatgccatgaaaaaaatatgggaagagctcttttagattgaaagagacttaaaagactaacaaacaaatgcagggcatggaccttgattgatttccagtttaaatgaaccagcttgtaaaagacattttgagaaaagcaagggaaatgtgaatatgagattgggtagcagttgacattagaaaattattgctaaatttgttaggcaagatacgagcactgtggttacacaggacaatgcacaaaatgtcatttgttgaaatgcatcctgatatatttagggttggaatgtcaggatgtctagctaaaacatgaagcaaacatagcaaagtatgagtgaaagatctatgtgatgggttcatgggtatttattatattatactttcttgtatatttgaaatatttcaaaataaaaaagtttttaaaaaccacaacagattaattttaaataaacaagtttcatatttagagtaaattttccagctttcatttctaaagtcttatctagtaattactgaggaaaccaacttatacgtctatcttttgcttaaagttttctccaattggtttaaacttttatattaattttctaattaattgctatatgcagtaaattaaataattgcaataattaaggagttaatataaatctgatggcaagttgtaacatatgttacctaaaaatataaaatcaaatgttcatatgcacagagttttaatgatttttaagtaattataggctaaaaacaatacaatagaaaactttgctgttgtaataacctttgtgtccacaggggaaattctgtaaaaactttaaaagtagtgtaatactattttgacaggttctgaacaaattacttggacagactgcttttaaacctcaaaagattttctagaatattaaaaaggtgttcaccttgggacagattttttttttttttttttttgagacggagtctcgctctgtcagccaggctggagtgcagtggcgcgatctcggctcactgcaagctctgcctcccaggttcacaccattctcctgcctcagcctcctgagtagctgggactacaggtgcctgccaccacactcagctaattttttgtatttttagtagagatggggtttcaccatgttagccaggatgggacagatttttaccactgaaccagataagatctttcttaagtaaaaataaaaagtgtcttattgtcacttacacattccttaaaattagatacagttctctagcccactgctacttaagacatctcatctattataatatacatagtatacataccagatgaaaatagaagcaagtggaactatttgggaatgcagcttgccgtgccagagaagttttcatgttgtagttttagtgaatatttttagggttaggataacatttcctgatgttttcggtgattagtattgtacagtaacactatgccaaagtagttctctgtcacaattgttagagggactgcttatcaagtctgtctgctgtctctgaactttattgtagcttcttccaacagaaacattctacttcactgtttaatacagttgcactacctcatgatcctgactccccacactcaaaagaaggcttagtatgcatctgtatgcaacaggaaacttcaattaccttagtagaatgatcacttttctagtcaattctttaactctcatttcatgcttaaaatctcagatcaaattaggaaagattacaactaagataaatccagggcctatttcaacatgttttccttgtaaactagtttctcttgccaaaataatgtactttgtttaaaatagaggtcacaacttggccccttgagagccaaatttagcctgcagttatggcttggccctttctaagtttacacacacacacacacacgcgcgcgcgcgtgcatgcacacgtgtgtatgtgaatgagttatccatataaaaacccagatttccagcttctttttaaaacagctgaggggctggcaatcagagcacaatactgggaaacagagcaattgccagctagaacagactggcagcagctccaatgtgcttacctgcccagccactgaaaacaatttagttatgtgactcctggtttacatgcattgtttgttcaattcaataaagtatctccctcattcctgagatgaagattttccaaccttttgatttgcctcctgtttttacttgctagtttcttattcttacaaggtaaaaaagtaaagcacatgttaaagttctgtctaaaaagatactctaagcctttttttttttttttttttttgaaacagtctgtcactcaggctggagcgcagtggtgtgactttggctcactacaatctctgcctcccaggttcaagcaattctcctgtctcagcttcctgagtagctgggattacaggcgagcaccaccatgcctagctaatttttgtacttttcatagagatggagttttgccatgttggccagactggtctcaaactgctgggctcaagtaattcacccgccttggcctcccaaagtgctgggattacaggcgtgagccaccaagcctggccggtactctaagctttttaaacaactactatcagatgagaaatctttaaatcacaggccccggcaaaaggaaatattaagtatggaaatactttcgattttggttgcctcacagaatcaaagtgggcagaaaatctcggaattcaagttgaggaacgtaatacagaaatcagtatggctctgtcccataataattattctgcatcttatctctaatcctgttgccacttgggtctcctgtgggtagaggtctatgacaataacttctttcttgttgccaaccttgatgattataatactagttgaccaaatgttccccttttggatgcttctgacggtgttctgttggaagagacagggtcttccctgctcatggaaagactttgttttccctttatggatttataatagcatatgggtaacagaattgtactgcaatgaagcatatggcaagtattttaaaaaatggagtttaaccttaaagcatgtgcgtacaaatttctgagaaacaaatccttgtctgaacactacaagtgtagatgtgatcatttgtttagtcatcatttaacatttaatacttgctcattgtgtctaggatactgaaaaagatagccctgaaaattcctgctttgatgtaactggagatacattaaatgaaagttttaacatcacaaagagcctccactggagacatatcattaaaaatctaggattcagcaagagtctctagagaaataatttaggagactagacactataaacaactgaagggttttcttggtatgatgtgtagctgtcaaactgaagcaccgatacgggctgaattttgttcccccaaaaagatatgttgaagtcctaactcccagtgactcagaatgtaatcttatttggaaacagggtctttagagaggtaatcaagttaaaaggaatacttagggtgggttctaacccattacgactggtgtccttataaaaagaggaaatgtggacacaattacacacagaaagatggtatgaagacaaaggactccagtgatacatttacaagccatggaatgcctgagactaccagaagttaggagagagacctgggacagatccttcccaggtcccttcagagggagcatggctctgccaacaccatgacttcagacttctggcctccagaactgcgaggcaacacatatctgctgttttaagccacccagtttgtagtactttgttaaggcagccctgggaaactgatattacataaaagcacctttcaaaactacattttcttattatataaggagggtctttttaaatgccaaattttctttatcttaaatgttttgacatggatttgcatgctcttttataagacctaaaaatcttaccactgctgatatttaaaaaattaatacctatttaacatttgatccataatataagtgaacaatgtcaatgactccctaatgctcaagtcaatggattctatttttcaggtcccattaaggtcagtaagaaagccttacgtagtatcattatagagaggagaaaggaatgaataggaaacataacaaatatgagtagtttgaggattagaagaaatcatttaactttttgtaaagctataaagttatcagtaagggcggccaggaatggtggctcacgcctgtaatcccagcactttgggaggcccaggcagacagatggcttgagcccaggagttcaagaccattctgggcaacatggcgaaaccccatctctacaaaaaaatacaaaaattagctgctcatggtagtgtgtgcctgtaatcccagctacttcagaggctgaggtgggaggatcacttgagcctgggaggtagaggttgcagtgagccgagatcatgccactacactctagcctgagtgacagagcaagaccctgtctcaaataaataaataagttatcagtaaatgcaactccatttatttttgaaactagtaaaattgatcattatattcaattctattgattatctcttctgtgtttttaaagagttctcagatattagtttgtttttcaagtttagtgtccattaatctcctttccattcacttagaaaataggttttaaaactgccataatatctcctattcatcatcagagtcacaccccattttcttcattttactcacatgtaactgtaactgtgttttcttagtttctggcataacatctggcatataggaggtacttggtaagtatttcttcaatgtaaatgccagatagggaaccaaatttagaaaagaaatataatacaagtattcaaagcccaagggcagatggctggtatgtttttatagaagtatttacccttattattaaaattatctcttggtgttgatgattttcaacaaaccaccttattaaaaagtataaattgttttgagacctctaacaaagcagggatacttcatctgcttggtaaggtttgtctcatgcacctcctccaagtgttttgacttaatcctttctttggaaataagctatttgcctaaaagctatttgatttccttggtctctaagctgtccctttctccttttgaatgaccggcccaatgatcagtacagtggggaggttctgacggtctttatgacccttgccttctggtattcatgcccttgtgctatctcctcactttactttgagtgtgggtgggacctgtgacttgcttctagccagcagaatttggcaaagatggatgtcactttcatgatcatgtaacctaaaattatgacctctgtcttgttagcagactctattgactcttccttgctggctatgatgaaggaagccaccatacagacaggttctttcccataatacaagtgctattagtttttactgctgcacaataaattaccataaatttagcagacaaatactacatgtatttattatctcacagtttttatggatcagtagtctgagtactgctcaactgggtcctctgctcagggtctcgcaaagttgtaatcaaggtgccagccagggctgtggtccaatctgaggatcaggttcctcttccaggctcactgggtgctagcagaattaaatttcttgcagttgtaggactgaggacttccgatcctaaaggctgtccaccactccctggcacatggccctctccctaaatatggcagctggcttcttcaagcccaacaggagagcatctctgctgttttgaatctctctgacttcttccatgtcaaacttttagagcctcttagaaagggctaatctgattaggtcatggccacttaggactatctcttatttgcttaacttcaagtcaactaacaaggaattttaattacatctgcaaaatcttttatcttttccacataatgtaacgaagcaaagacgtgacatgccgtcatattcactggtccaacccacactcatgaggaagggattattgagagcatgtggcaccagcaggtgagaaacttggggttcatcttagaattctgcctaccacgactggcatatcttactaccacttgtgagctttacttccacttgactctgatagtttatattttagtatttttgcaatactgtactatcattgcaacagccactttttattatatttacctttaataaaattaaaattctactaaatgtaacatttacacagaagactattttttaagatttcaaaatcacatctattctgaactaacatccttacaacccctgtgcacgaaacgcaaagatgaagtttctttttctttgtttaaatggggcaatggtcactgtgactgaagaataaagtgttctatttacaagctagaatggggaaaatgaagatactttgctttgttgaataagtagtacctgagagcataagcaaacaatgtttctatcagagtagacttgatagggtttggatgtttgttccctctaaatctcatcttgaaatgtaatccccagtgttggaggtggggcctggtgggaggtatttaggtcatgggagcagattcctcatgaatgcctgggtgctttcctctcccataatgactgagttctcactcagagttcatgtgacatctggttggttaaaagaatgtggcacttccaccctctccctcttgcttcctctttcgccttccatgtgacgtgcctgctcccgctttgctttctgccatgagtaaaagctaactgaagcctcaccagaagctgagcagatgccactaagctccctgtagagcctacagaaccatgagccaattaaacctcttttctttataaattacccagcctcaggtaattccttatagcaacataaaaatggactgacacaagacttagcagctttatccttcctattctttgtggcagagcactgtgtgactgaaccaaatgtggttaccactgtcaatgccaggaaaagctgaaatgagcaagcctagctatgttcacctctcctatggtggtgatcggtggaatggtcaaacactccagatgataccaaataatctgcaatgttttcatggcaagtcatttccctaaggaaaggagtaggggctgggcacggtggctcacgcctgtaatcccagcactttgggaggcccaggcaagcagatcccgaggtcaggagtttgacaccagcctggccaatatggtgaaaccttgtttctactaaaaatacaaaaattagccgagtgtggtggtgtgtgcctgtaatcccagctactcgggaggctgaggcagaagaattgcttgaacccggaaggcagaggttgcagtgagccgagattatgccactgcactccagcctgggcaacagagagagcttccatctccaaaaaaagaaaggagtgctgggaagcaaagaaacttctgcactcagttttccacagatgtaccatttatacagttgcactgaaattttctttactcaggggtaaatgcattttgcatacttctatattttaaaattatttttgcccccattttgtcaattgctaatgccaagtacctcctaattttattaatacttatcaatgttaacagtggaactgaccagatatagtttattaaaatatgttcattataaacaattttacctcagttttgtaaaaattgtaaatacatcaaaaactgttacagtgtcgtaagattgcaaatattgccttataaaattataaagaagtaaaattgtttagtaaaaactaggaaatatcttatttcaattttccacatataaaaatatattttttattgcaatactgaacagttaaggccacaacactttagggagaatttgagatacacatattttgaaatgacttgttaaaaatattagcataaataaatatcaaaactggtcacacttatagaagctgaataaaacatattaagtcttatatcttttaaagactactatcagaaactttacttcataagttataacatttttcaagtatacattacaatacacttggtgactgtgaaaacataaatatatatttatagtattgtacaggattttgatcttctctctgtatttgttggtgggatattctgatgattctgactcatgtggttctggtcggcatctttattatcactttttaaaatgatctggtctcctatggattttatctctgggagcggctcattgttattcttgacaatcttttgatttattgaggggactcttttgaacagaaaaatctaggaaaaaaaccacacacacaaatattcatttccataagtgaaacattcacttaacagtatttaggggatatcattttcaacacgtaagaacatgattttgtcatctctttatggggcaccacatgtactatggtgcattcttagcatctgttagagtttttcctttcaccaaaaggcagtcaggattccaccctaaaacaagacctctcagggtctaacattcaacaccatcaacaccttggtgatatctttttcttcaaagaacaaatttaatgtttcactttgttaagttgtaagagaaaaaatatataaaaacctatttaaagttacctattgtaacttttaaatgtatccaggaggggtcattttcaggacatgtctgtgattctcagtgtatcgcagctacagtgaatttctattgtaatattctgaagaaggacgatgtacctccccattcctgtagatgagaacttctggcaaaaaagttaatgctgcttggccaggcgcggtagcccatgcctgtaatcccagcactttgggaggccgaggcgggcagatcacaaggtcaggagatcgagactgttctggctaacacagtgaaaccctgtctctactacaaatacaaaaaaaaaaaaaaattagccgggcgtggtggcaggcacctgtagtcccagctacttgggaggctgaggcaggagaatggcgtgaacccgggaggcggagcttgcagtgagccaagatcgcgccactgcactccagcttgggcgacagagcgagactctgtccccaaaaaaaaaaaaaaaaaagtcagtgctgccaaatgatggctgtgtgagccctgtgtgtgggtctgagtaggcagtcaaatatacagagctgctgctcaggggaggctggggctgcagatatgtagaatatagataatagctgagagatgaaagtagccccgataacccagagattccaggcaggtagaaaacagaatataagaaaagaggcaaaaagagcagagtgagaggcaggcagaagaggagctagaactgaggaccaaggtttgtaggtgcaaaattgggaaaactaggcagctcagaagtcaggagagaaaaatacatcaagaagggagtggccaacagggcatgtatgcagaagagatgaaggtgataaaagtttcatttgatttaggccctttgagaatgtagccaggaagaaaataggattattgaagagtggtaacacaaataatggttttgacaagatgccaaaacaaaaagcaggaaacaaaaaccaggtgaaaatttggctcttccagaaataaaaatggtgctaataataatagcttacttctagctttaaagagtggagaaactagggtaaaaagtgataatccaaaaagtaagaatctagaaaaaggatctatggattaaaatggaagaactcctgttcctgctatggtgaagaaatacacaacttcaaaaagactgccactataaaataccaagaaatgctgattaagtataaaaaatataattttataatgtgcaggtaatctccccaaaaactaagggaaatccttgtagaccaaaaaagaaagaaggaacaggaagcctcagaggtcattaagaactgaaatagcatctgctgactcataacttagacttttaactttgaaacaatttgatctcacaaaatgaggggaactggaactgagacccctacataatgtgaggaccttctaagtactatgcccttaatataagtctacctacaaacattgtggtctacccttaaatgagaaatgaacttaaagtggtccttcagtcactccagagctaataaaggctaatgcaaactctctatagatagacttactctaacagaggccttaaaggatttccacaaaaaaagtaccagtgaaacatgaactcacaatacaaatttcaaaacacatatggaaactaatcaccattagcaagtcagccaaagcaacacacatttagactgctaaggatgacactggaattactaaatacagaatgtaaactaagtgtgcttaaattaaaagactagaataaaaaaagtaagcataaaacaagatactgattttaaaagaccagattgatttgaaaaagaacaaaaatacaacttcacttaaaatgtgaaagatgttatcactgaaattaaaactttaaataggtaggttaaatagccaagtagtctcagctgaagagaaactatgaaattgatgaaggccctgaaattacccagaatatcacttacacatagaaaacaagaaggtgatattaaaagacatgtacccataaaataaaaagttttatatcagaatttgaaagaggggagagaaaatattcaaatatataatggatgagaattttaaaaaaattgacaaatgacatgaattctcagattcaagagtcataataaattccaagtaagttaaaattaaaaattccatacctgctgggcatggtggctcacgcctgtaatcccagcactttgggaggccaagacaggcggatcacctgaggtcaggagtttgagaccagcctgaccaacatggagaaaccccgtctctactaaaagtacaaaatcagccaggcatggtggcacatgcctgtaatctcagctacttgggaggctgaggcaggagaatcgcttgaacctgggaggcaggattgtggtgagccaagatcgcgccattgcactccagcctgggcaacaagagcgaaactccatctcaaaaaaaaaaaaaaatccatacttaagcatctcatagtgaactgaaacacaccaaagacaatctaaaaagcagccatagagaaatggcaggttatatacaaagttatcagcaattatactaaagcaaaattatagacagcaataatgggagcagatactaagagaaaataactgtcaacgagccacactatcattcaagaactatggtaaaataaagacattttcaagtgaacagaaactaaaagttttaactgtcaacagacatctgtgataggaacttccaaaatatttcttcaggaagaataagaattccagaggggacatctgagtaaaaaagtagtataaaaaatactaaaaacatacgatttgtgatgttaaaaaattttaaatactgggtaccataacttctaaaataagaaagaagaggtgataggcaagaaaattcttctaaggtcctggcattatttgggaaaaagataggaacattgatgagctttagattttaggtatgcatgttaaaaatgtcaaagacaaaatccagctgtataggccatttacaagagacacatctaaaacataagctaaagtaaaaggatgaaaagaagatcatcattcaaatgctaaccaaaggaaaggtagtatattaaaaatatgcgacatcacctgaaattcttcaggttttggggccatgaaaactcatattaagagagttaaattatgtggattgccatatgaaaagtaaaacaaacaattgaattcaaaaggatcaaaaaagacaattcatttcacttaccttctttgtttttttcatgtctttgcttggtgttgtttcactgttttctaggatttctaatgaactgctatctgcatcatcaagcatgtatcctacaattggatcattcagaaatactagttttaactaataggaaaaagacaagacctgatgctctcagtgaaactctatgaaccctgagttgtggggtaatacgaaaagagctcacccctggagtagtggacaacatctacactgcatatttcctgaaaagttgagttaaagtgaaaagcccagaatgacctcaccaaagttgtaaatgtttagatgaccagtatccaaatatagctacaaaggtaatagtcaatgttagagaagacttctgtaaaatacaaattactttaaaaattaacctagttataattacattctttgtactcaaatggacatgctattttttggtgtttcaaattaatccacatgttctatatctgaataattatcttcaaagtatacttgtgaagcatatgcattgttttaattttatattatcaactacttttaagcttatatttaatttctttgtagtgctttaggctatatgttaagaatacttataggtgatacattttttaacacttgcctaaaatattctaaaacttactactcttatggcagaagttaaaaggaacaggattaaggaaactattcattcttcagcttaagtttagatcagatatccagtattacagatagttatttttttatgagaacacaatcatactgccgtgtgatggtgtggaaacaatgtgggagtcatactacagaaacacagatgatttgtgtctagattatgtagatctcaagggcaatcacagtctcctctattccacagcacctgctctctgacactgataggtaggcttgggaaaggacttctcttcagtatctacggtaagacactcaggtctgagccctcgggggtaaataactgggtggccattgtggctttaggccagcccagtagtcccaacttggttgggcaatggagtctagcagtgtgcactagagatataaattggaatttggggcaaaagcttgatttaataatactgatttaatagagagaaaaaaggtagtaaaaaggctacttaaattccttaacaccagccgggtgtggtggctcatgcctgtaatcccagcactttgggaggccgaggcgggaggatcacctgaggtcaggagtttgagactcgcctggacaatatggcaaaaccacatctctactaaaaatataaaaattagccaggtgtagtggcacacgcctgtaatcccagctactcgggaggctgaggcaggagaatcacttgaacctgggaggtggagattgcaatgagctgagatcgtgccattgcactccatcctgggcaacaagagcgaaactctgtctcaaaaaaaaataaaaaattccttaacattgacacataagtagccatgaataatgcaatatttgtatgtgaagaagctgtggtggttatatataagaacagataagtctgtatcacatatttcatagcttgttatgaggatcatgtgacagtaaaaattatagcatatatgtaaacttatatgtaagcttataattacccaattatggcatacatacacatatatatgtgtgtatgtatgtatgtatatatgtatgttatcaaatgtgctcataccttttgggttttcattgtactcacaaatggcccgttcctctaggttggctttttctttctataaacaataacaaagcaatataacaaaaaatatttttgtgctgttctagaaaacttaagtctgaatctttaagcaggttctagagtctgcctctagctaatgacataaacatgtgacaattacttcactttgctgagctcttgtaaagtgaggggccttagatgctgactgattgcaaatgtcctcctagcttaaaattgtgtgattaaaaaaactgtatgactcaagaattctcctcaaagaagattcatgaacgctaattggcatacaacttgtctcaacattttacaatgtcaaattggtatttaatgatttctatgttaaataatcttaaggaccaccctaacctgaattcataaatgttccctataaacagaatcattttctccttctgaaataaaacagtaactgctagaatattttttttcttagtgagagaaaggagtcttggataaagaaggaaccaagcaaaagaatgacctttaccacaataccaatttgtaaattaaaaatgtatgcacacaaaacatgtttcacaagtacacattcaaataaaatgacaaatatgtttcagtggttgtctatgttagggaaaaaggggaaggggaatggagctaaaagagaatacatttacatgagaagagccttgcaacagaccaatgatgagagtgtttcatactagaaggtatgactcagtgttctgcatgagaggttcaaaaaatgaaaataaagatgaatcagtacaacgtcattcactttgggttgcggaattccatacttctgaagttaatccagagtagtgttagcaaacaaatgatttcaaacctacaaactatctcctagcaaggtcactctcagtcaaaactgccaatggaagagattatgttttgggcttctctagctccactttcagggtgatttttgcttccttagtgatatcttctcctattccttctatacataattttgtctagactgcacctttgaagaactgatcacaacttcaaatactgctgtgaccaactttcaatcattcacacatgtaaacatacacaggtgtgtgtacacatacacaccccatttctgccaccagtgccagggctcctaactttgcactttcagcatttcaaggactgagtgctgaacttcttggttaatttcccaacggtgtactatcctggcccataccattctacttccactcatgcgggaggcagaatgctaccaagcagcattctagaaagtgtgctagagacaaagtttgcttagttcacaaataagccaaagcctttctcttatggcacatgaattcatgtattcatgtattcatgggagtatttctgatcccaaaggcaactggaatctgtcctctgcagaaactagagaacccatatgttttctcccaggatctcaggatttaagcatctatcatcataccttttcaatagtttcagctgagctatcatcattggttctttctgctccttctgttttactgtgataacctgtaggaacactttcatcatctcccacagttttcttcttgctttccacattttcagcattaatttcctcatccacatcttctagttttagttcctcagttttagaaaattcatgatcctgtgacaaaattgaccatcagagaagagtaagattttcttgttaaaaaacgagggatttgatattgctgtcataaataatttgtgtcatctaaaaaaaccaggaaaatattaattcaaatattgaagccgaagaaaaaaatactgtacagtccatgctgaatatcaagttactgtattaacaaggattttacgcatgccactctatttcaatgactaggatttccaaaattcttactagcacccatggcaaggttacaatggaaaaaaaaaataaatactctttcttggttgtctcacaatgctttcaaccttgagaaaagtttaaaaagcgttctgtctactgtagcattataacataatcatatctatatattatattcattttccaaaatatagggatttagaatcacttcagaagtacgattcactgacagtcatgaggaagataagtataattatttacattccaggaaaaaagataaaggaacatagacagtttaaatggtttgctcatggttattaaaagcagaaggaaaaccaaacagaggcagaacttgttctgtctggctactggccagctaatccaaacgataaaagaggctgtctatggatttgatagactgatagtaaatcatggaatgcttattaagtataggcagaaaatattagtttcagcctttattctacactgagatttcttttttttttttaactttctaattttgggtgaaatactctgattgtcattaagatattaggtttctcattagattcccccccatacttttcatttacacacttcactaaagttataactttatagtttattataattaagtttattataactgcttctaaaatatgtgaagcagttatcagtgccatttactccttcaaataacatttgtacaaagttcaccttggcaatatttgcttcagaccatatccccttcaacactgtaattagcttttgatggtcagctttctagtagctgtctggctaaggataaagcctgactgatactcaacagaatctttagtaggtggttggaaaataatgcctctaaaatttaactcacctttcttctggtaaaaatataaaatgcgagagtccaggctaggaagaggatgtttatacagtacaccttaatagtaaacattagtgtcatcctcaggccaattgcaaaggcgtggcctaatagcattcccactgaggacaggaagccctaagtaaataaagctttgagattttaaaaagagtttcagaagctactcaggaagaattagatttaggttaatccaaggtcatgaggcaatgtatgcaagagaggaatgtgggagaaaggaacatggtaccagggcagacagctatttcaaatgatgattgattagactgggtagggttaacatgaggtagttatcatttacttttaagctttgtttttgtctgcatgattccaaccgcctgttttttgcttttgtttgagacagggtctcactctgtcacccaggctggagtgcagtggcacaatcttggctcactgcaacctccacctcccgggttgaagcgattctcctgcctcagcctcccgagtagctgggattacaggcacccaccaccacacccagctgatttttgtacttttagtaaagacggggtttcgccatgttggccaggctggcctcaaactcctgacttcaggtgatcctcccgccttggcctcccaaagtgctaggattacaagcgtgagccaccacgcccagcctgatttccccttttgagtgacttatattgtgtatcatgcctagccaggtatacattatgggtagctaaaattatcagaaacaacttcactttgaaagggaatgggaagattactagatttaagacttatgactgatagttgtctgcataaatatacataaatgaaaggttaactaaaaagaacagtgctcctgagacaaggaatttcagactatgcccctcttttcacagagggagggatcagtgagctgtgttcccagcataatcctcaattacttgggaagcttggctaacctagcacctgggtcaactccaactgggcttgttaactgaggtattcatgtaaccacaggataatgtcatgctattataaaaagacacgtgggagttttaccttattttagaaataagtaaaacactcataacaaactacaattttactcattaactttaaacaatctataacaatgaagaacttttggaactatatcattttctaaatttgagaaagctattagaaaatgacattttcactagaaatcacatcatagcactcacagactaagcacatttaaaattattctaaacacatctggacgactacttgaagtcacagaaagcacttaccttttaaactgaaacaatttgggagtgactggcagaatactgtcattttataaaaagaaagagtaaagtttaagtacattcttggcactagaaccatctaagaagatgtaaacaggtagtctgaaatggtcagtatatgtctgtgtcttgcgttaggatcacagtaaagaagtgaatgggcctgacctctcacaaaaggaccctttgtttcattggtcaggcatggcacagtcaggtgcagactctggtctggcccaaggcaacacttttcatatttcttaaggaacagaacaagagagcaaaggttcctactgaggtttctgtttacttaagaacacaattacatcgcatgctttaaggagaatgctgggatgggggctggggggtggggctgagagtgggaaatgactgaaaggggttaaagtgaagcttctgagggagctggtactgtgtttttccttgatttggatgctgatcagtttgtgatgggtgtattcactttgtgaaaaatatattgagggacacatgtatgagataggcacttttgtccgtgggtattatagttttttaaaagtaataaaacaaaccagagctataaagtataaaattttgtgctataattcagaatttctgacatgcttcaatgtcatgtagggtagaaaatgtttcccagataggttaatatagcataaaactttgtatttaagttatatcaggtagaaaaatcaaaatttcaagtatatattttttttttggacaggaaaagttaacctgtaagttcatgttttaactacactgaaaatcatggaaacagcagtatggggtgggaagggcattaaatacaaagccctaagcactgctttccaagccttaatctaatcactcatggcctgagcatggcacccagtgaatgtattttatagtctacctgtaaaatggaaaaataacattagcaatacctacctcagagggtttgtgtaaagattaaaaagattatttacagagaaaaataacatgagcatatactatatatttgtatataagtataaataattttgtagaggcccctccataaaaagtaagatagaattcttagtgtgcattgaggactgtcgaaaaacagtaagtttggacttttttttcccataatgtcccagatcttatcactggaaaatagttcatttaaaacgtccacttatttttgtgtcctctatacatccttttattgtgagccaggagcctagcatcaaggccagtgagggaaggagccatgggaactggggagaggggtgccagcctcagctcagcttcaggtcagtgttgccacagtgtgatgctcccagacccaggctttccaaaagtccaagaaacattattattatttgagacagggcctcactctgtcactcaagctggagtgcagtggcacaatcacagcttactacagccttgaccttcagggctcaagcgatcttcccacttcagcctcctgagtagctgggactacagggcgcacaccaccatgcctaactaatcttttaatttttttgtagagacaggtttttatcatcttgcccaggctggtcttgaactcctggcctcaagcaatcctccagcctcagcctcccaaagttctgcgattacaggtgtgagtcaccatgcctggctgagaaactttttaaatgtaaaatctcctgacatttcaatgttggcaaccaatatgatttaaataaaaaaaaactgcaccaaacaaaataagtctgcaggccagactgcacccatgggctgccagttgtgatctccaaattcttggctgatcatactactttataatctcttaaactcttccttctttctaggcaccactcccttatgtcattcctaatcctgtattctcaccactgaatacattccagtttgataggcaggcctacagaaataaatgttcagagtatagaatatcttgctggcgagcatttttattctcattttcagatttattctttactatctctactctttttccttagaagattttcttgttgtccataaacaaatgcatgatccacgactataccttatgtgctaattatttttatttattttgataacaaggttaggacacagagggaaatgttcagtgacagaaaacacacctaaattttcggctaaccacatgagtgtgatcagcgtttcaacacactttaaatatttaggggcatttattgactaatgtatggtgtgtaatagtttcactccaccttatacttaagcatgatcattattgcaatctactttattcccacagatctatttctataagccaatttatattttgctattatgttacatttaaacaaaagtcaggttcacatgactaaactcacgcacatcagtcagtgacctggagattcatgagtgtagctttgcacctaccttggtgtgatcacagagtataattagagtgatacaggttaccatttgctgagtgcctataacatgtttcatgtgttaggtaatttaatcgtcaaaagtcccttcctttatcaaatgagggaaataagactcagaaaggtcaaataacaaccaccaccaccaccaccaccacaacttttctaggtgtccacacagctcatcagtggagggctgggattttaactcagttctactggactttggagcccatgtttgtttccaaacctgctcatttaatttgaggataataatggctgttctcacagatgttttttttctccgcctcactaatgtttaaagcattgcagatttttcttttggttcataagctcacatcaataacactctattcttatgtatatattaattatgaacaaaatttatcatcttttccccagaaaaccaaagtctctggagtacacatctcccttcctaaattgagaaatatgcttaaaaaattaaatattttaaaaattaaatatctatatctgatatttaattttcacagttctgattctattcctctgcagagcagatttcccggagctcattctttcctggcaatgtgggttctgcccctggccctctactaggctgcctcctagaggctctctctgcagctactaccactccttcctctctgaaaccccttctttggcttgggtggtatctctctttcctagtaagtatgctcccacacctccttctcagacttcactttctcaacctctcccttacctactgacatttctctgaattctgtcttcaactctcctccattcacattaggaacacttcctttcagtcaaatccagttttaactacatctatgagctggcgatactcagcagtctccgtgagctccagatccatacaggtatctgcctcctgaacatctcctacaatctaaaatcaacagtaaaaaactgtctcccaaacatgcttctgctcccttattctcgatcttgctgaatagtactctttctactcagttctccaggtcagaaacaagaaaagcttggcctttccttcttccatggtcacattttatttttgctatgtaagtgtatagcaagtttctctatagtgaaataatagaagacatttcagttgcactcaccttgactgctgctgttcagcagcagcagcagcagcagcagcagcagtttctgtggtaggtaatcctttgcagcttaccttaaagtctttttcagccagagtcctcattaggaaatgtaactcaatggattctatatatactactcacacttccctcaataatgatcagtaataaactactataaaagcctgaacaaccagcagatgggaacaataaagaaggaaccagttattttaatctatataaccaagtgttaattcatgagggacaaagtggtctcattcttaagcttccttttttttctcctaagatatataaaatttacaaacatgtaaatcacttctgtcgatgaaagcctggatagacctgggtcttttgtaccccaacccacccctaacccacaatacactcctctccataaactttttgagggtactagacctgccacatgtgattaaataaatgttcgcccaacagtgggcacagaaagttagtgtgtgcttagtagtttaggataactgtttactttagtataactactagttagtttgaatgtggggtcgctttggtgacgagacttaagattttttattgaggaaaaaggaattgcagaaaatctgggtgtgacagagctctagctggtaatgaacaactgctgttcctatagaatcccttaggtcactcattctcattctataattttccagatgaagaaattgaggactgcaaagctaagagactagcccaagttcagacagctcaaaagtacaaaaccagaagaagggctttggtctcaaagtgactagggaggccagtgttctccactagaaaacaatgcttgcatgaactaccacttctaaagagcacaaaatgtttttggccagggaaatgtgaagaaatgctatttaaacgtggacatatagaccaggtttaatactgagatgggtgtattttagaacgttgtttctgtattactggctgattatctcttcagtagaagatgaatgctcatagctattacattaataacttgagtttaagagtttctcatttccctggaggtttttttctttatgaattctgtgtcatccatcttaattattttaaatctactttttaaataatcatgttcggcacatatatttttatcatagtattaattcttttctactatcccttaatgaatgtggtcgaattcggtaaagcaatgcaatgccaaatcagtacatttggttagttaggggaagctgccagagatccttgcagctaaggcaaaacttacaattgctcctaggaaatcctttacttcatacgattctagactttttcctcatattctttctcactcagagaatcaactgtgcaaaagaactcaactacacaaaactcacaggaagtttctcatcaaaatcctccttaataaaactaagtataagaaatctctcatgcccaggatataaaagggactatgaaaggaaattagttgaaaaaggagccacaaataaactatcagataaattagctgcattatgtacacggaaaattttaagggacaattgaaattactctagtggaaatctagcctctctaaaattcagtatctaatactagacagtttatcttttcataaagaatttctgactatatacatttaattttttattttacttgaaacattctgacaaggaacagacaaactgaaattacagaacagtcagtgaatacattgagggcatataacacataccagaaatgaaggctctgataaagtacagttaaagcttggaaatgataggagtttagaaataaaaaattacagaagacaagagacgttaaagctgtcataacttttcaagagtaaagaaaacaactgtatagaaaactaaattaattttaaagtgtaatttttctccctaaaacgtttcttacatgaataacaataatgatagagtgaatctgtgagaatgaaaagaatttaagagttagaagggactgcagttatcacatcatctcatccactccattttagagatgaagaaactgaggcccaatgagtacctttgcctggacaaaaaatacttcaagttttacatatttccagattatacatttaaattaatcaccatttcattagatatactaccatctgcccagatagtaactaaaagagatcacgtttttgggatctaagctctgaacacagctgtcactttgtagatttttgcaaaaagaacacataaaaggtgaaagacaatactttctttaaaatgtgaatgcctcaattgagttttagaataccatccattattagaaaattattctatacagtaggtaaactgtaatcactaacttaaaaaaagtgctaacatatttataagaaattagaagtttttatagcccttaagcatctgtgccatttaaaaatggaatgatttgtatacacaaacaaaacactcttgtagtatattcctgtttcctaaagctgcctttaatgaatatataatgttaataatctgatatgaccttttaatattttctagttatgtttttataatttgggggggaaatacacgaaaattttagtttgagagaggccaaaatttaccagtgcctcctattgtctttggctccttaacacagctgcatcagttgcttttttttttactacacataaaataattgacataaaatcaatttaataacacgtaatgagtgcccgttatatgcaaggcatttaaattgtctgactggccataatcgggtcacatttaaggtttgttacttcaattccaagtaatgtggtaatacattattccagaactttttggaacctgatggcccgttttttaaaagtcgttttgactggactggcattttggacctctgctctttcccatttccctgtgtgttagtaactgactttttttgatatgttttatgtttgccatatttcacagatccttttattttgctcacttttttgtactcctctccatcctgcctttcattctcttcttcgcctgtctcctgatacttcccctcttcttcctcctcctcttctctgttcctcctgttttcttctccttccccctccttttccctttcttctccttcctcctctccttcctcttcctctccttccccctctccttcctccccttccacctccccttccacttccccttcctcttcttcctccccttctccctccccttcttcctctccctctccttcttcctccccttcttcttccccttcctcctcttccccctccccttctccttcctcctcttccccctccccttctccttcctccccttccccttctccttcctcttccccctccccttctccttcctcctcttccccctcccattctccttcctcctcttccccctccccttctccatcctccccttccccttctccttcctcctcttccccctccccttctccttcctctccttcctcctcccctttcccttctccttcctcctcttctccctccccttctccttcctcttctccctccccttctccttcctcctcttctccctccccttctccttcctcttctccctccccttctccttcctcctcttccccctccccttctccttcctccccttcttcctccccttctccttcttccccttcttcctcccctttcccttctccttcctcctcttccccctccccttcctcctcttccccctccccttcctcctcttccccctcaccctcctcctcttcctcttccctctctcctttcccctcctctacttcccctccctctacttcccctccctcctctttttcctcccctctcccctctgtttcctcctcttccccctctccttggtctccttcttcctctcctttctcctccttccccgctctttcctcctttttcctctctccttcctccttttcacgttctccctccacttcttccccttctccttcctctttcccttctccctccttctcttcttcctcttctctgtctccctcctcttcttctccttctccatgctcctcctcccctccctcctccatctcttggtttctttccttctgatggccctgctccctctccttttgctcctgctcttccccatccctcttcttccattcttccttctctgctagttccttctctccctctcctggcctctccatttctcctctacccttgtctttctcccccttctccctctcctcatcttgccagtgttctgctcctgaactaccttcctcacaggttccatcccctctaccttcaggcccatcctctgcttctcccactgattttgccttgccttcactcacctctgctttgtctgtaaggtcatctgataggatctctgttttctcctttcttcctccatgcaccttcacattttcctcatttgcttctacctcttgctcctctattccatttccttttgaatcctctgctccttccttctcctctgggatctctgacaagcgatcacatttaaaatcatactttgccatggatttggatattatgggtttagtctctttttcatttccttgttcaatcaatttcctgccataccgtatgttttggtcagtttccacttcatcatcctctttctctccactactaaattctattgcctcaggctgctggaatccatcagctataccctgttgactctcacttgcaccttccatgtaactgtctggcttttctactgattctctttcactgtcaaagatcacatcttgcttgcaactttcccttttcttaacaaaatctttattttcttcactctcagtattcatacctctatctggtaagttgccaaagaaaggactcatcttttttgtactcttttccctttctcttaaatccttcatacctgctatttctgccagtttagtttccttctcactgtctatttcttctgcttctgattccttctgactgtgtcctccatcactttccttttctatttccttagcatcaagttgatcaacaccattattattttcatgtctatatacctctttttgtaaaccctctccatcagtgtcagcctgaggtcccacctggcctgtgtcattacctacttcctcatctgaaaatgcttcgatagtcgtagctggctgcgtcatgaaaatcccttgtgacacatgttgtttacatgctttcccttctttcatttctgacatttcttcatattcatcactatcatcgttttcagtaagagctgtatcctgcgtcagttccccaattgtttgttgtttctgtaaattttttgaagtaattatcatatgtcatactactattagttgacaaggacaacttatctactttaaatactgccaagattttacatttttataagtttaggagaatcaaaatagcaagttttaccagatattttgctaaagttttgttttctttaaggatcatttgtgccactctctagtctgtgatacatctaattttgatttagtaacatgtatctgtgtttaattttcgattcttactacctgccataattttgccattaatcacaataccatcaatatttactctctgcctcttttctcaatccgaatcaatccttacataaaacttcgagattaattttgcaagatgctatttaaaaatgtacacttcttggcctggcacagtggctcacacctgtaatcccagtactttaagaggccgaggcgggtggattacctaaggtcaggagttcaagactagcctggccaacctggtgaaaacccgtctctactaaaagtacaaaaattagccaggagtggtggcacatgcctgtaatcccagctactcgggaggctgaggcaggagaattgcttgaacccgggaggcagaggttgcagtgagccaagattgtgccactgcactccagcctgggcaacaagagcgaaattccatttcaaagaaaaaaatgtacacttttcttatacatagtacagcttagtatatttttcccactttcccgatcatctttaattttcaatttttttttcttgagacggagtttcattctgtcacctaggctggagctcagtggcatgatctcagctcactgcagcctctgcctcctgggttccagcgattctcccacctcagcttcctgagtagctgggactatgggtgcatgccaccacatccagctaacttttttatttttagtagagatgaggtttcaccatgatggccaggctagtctcgaacttctgacctcaagtgatctgcccatcttggccgcccaaagtgctgggattacaggcatgagccaccatgcctggcctaattttcaaattttcatttgtcttttgagtccacaaaattcacaaaataaataaaaatgtaaaatttgaaaaaaatgaatagtccactcctagaactgaagaaactgcacatgagatgttttttatctataaactaaataataatgaatatatttttcttttctaaacaaaatcttcatgagttttcaaatttttgaccttcttccttgcattgattatattatttaattacaataatttctataaatgaaagaacactaaggaaagaatattaagtgtaaaatgtaagatttgtacaaaaactatgaaatcaaacactgacatttgaataatacattaacaatacaaaattaatttcctgctggacaaaataaggcaaaaccaaattgttgatctaaattctacaaacaagctaatggatgcaaatatctaatgaatttgggtctctggatagtaaaacctcactaattcaaattttataaattgtgatgagttaggcctaggaagaggttcctattgtgccaaagaaattattaaaacatgacaagttaaaaattaacaagttaatacacagaaatagtataataaatcttttctcatttactaaagtaggcctggtagggcctaaacttaaaaagactatagaaagtataaaatatatgtcagcttaaaaggaattgctttccgtttctggctgttcttgctattgctctttaaaaagtcatgattcttttaagagccctaagagaggaaggcccagttgccagaactgatttctaaaggcacatgcctttctttccctagcacaataaagcagcccagaagagggagagcctggagtctaagggaagaggaaggaaagacacaagaaaggtgtctgcttggaagtatggtcagtcaaaaatcagtcaatattcattgagcttctacaactgtgttcgaacagctctcccatattcaaaggaatgctgttattcaccatgcctttcagtattatagatagaacgaatgaggactagctctaaattttaacaatttagtatgattctcttgcacttcagtgacttcaattttaagagttttaaacttgaaaacatgtcaaagacactataaatagaaactaaatattttttatagacttcttccctcaacttacatttctccaatttactttcctaatcctctaatccctcattcattcattgcactagtccttaaagccaggaaaagcaaaggatttcagggcaggcctttatctctctatggttgtgaaaaccacagcctattcccttcttttgcaatttgttattcattaaaagtctctctttcctacccatgaacagtctctaatttccaaatgtttaattttatttttatgctatcaatttcttgataaattaaagcccaaccaaatattggaaaaggttatcaaagattttcactaaaatcacaaaattttaaaactaaaaaagatattaatatcattcagtaaagtcagcatagtaattaattcaaagtcatactcaaccaaagtcagagggccactctatcaataaatggtagtcttttcctatacataagaactgcaatcataacctatggcttgacagaaggaaaagtatggctattataacttaagttaatgatcccaaagagcaaatttcagcaataaaatgcttccactcttgtttctttacagaaaatacataccatcagaacaaggcaaaatggaggttatctacattgtatccctctgtcttttaaattctaaagtaagtaaatgcttacgtttcttgtgttctttccaaaaaccatccaaaaaattaacttaaactgctctcaccaacaataacgaaaataaatcttcatattataccttttgtttctgaactggtgataattttaatgacttttcattggaattcaggctcatgatgtgtgtctgaaataaataaaaaatatatattataaaaagaatacagtatatatactatatatttgtatatagtacaaatatatagtatattttcaattatatatatttttttatatatatatatatataaaatgaagggaaaacagttcagatagtaatagaatccgctctcaattgccatactaataatgtgaggatcaaaacaaattttattgtatgtgaattatacctcaatatagttggttaaaaaataaagtaagaaacgagaaagacgctttcatgcatataagagtataggaagtatacacacattcacatacacaatgaactaaaattcaaactcatatttagataaatagataggaaatcattaccatgtttaagatatcagtagtttctccaaggctttctacagttgaagaattatctatctctgcttctttggtcatttcatctagcaaataatctgaatgattaaatgggaaaaaggaaatccagatttcaacagaaaagtgaaaggcaactggacagaaaacagaaattattctataatataaagtgtaggtataattttactaaaagtcctttaacctcatgtcagggaaattgaaaagaattcattcacaatgacataggttttaaaatctttgtgaaagtttaaaaacattgacaccaattagattacaattgtttcattcatatgaacaggcaaacactattcccttgggataaataactacccaggtatcaagcactgtaatagctagtcctaagaagggccccaatgacctacaacgtcctggtgttcatactcttgtgtagttcccttgcccattataccaggttggtccgtatgtgcacagccagtaaaataaagcagatgtaattgtgatagcattatggcttctgttttggttatacacgtatgcgcacttgtgctcgctctggctctcttgctctctctctctccccctccacccccagctacactcgtgcactccctctctttctctctaatcacttgctctgtaggagtccatgttgtgagcatctcaaggaagtgaggcctcctgccaatggccatgtgaatgagcttggaagtggatcttccagcctcagtcaagccttcagataactgcagccccatctgacagtgtgactgcaaccctatgaaagaacctgggccagaaccacccagctaagctgctgctggactcctgactctcagaaactgtgtgaaataataaatgctttttgttttaacctactaagttttagggtcattttttaaatgtagcaacagataactagtataagcacctagaacctttcacagaaaactgcaaggttattacatcataaagtagataattaaaagtcataggctctacttgactttacatttttctcagtttctcactatgccctcattgatcaccaatacatttggacgtagctccttaatgaagtcttcactaaaaaatgacagtccacactgatccctcccctttaaatccactgaattgaatgagcaaataactatttggtatttattccatgtgtggtaatctgcagaatagcaacataagtaattgctaattcttttttattttttatcgtctatatttaaggtataaaacatgtttgggtatacatatactaataagttcattaagtattagcaattgcaattttgttgtttgctgttaaaaaattgtaattgctatttcttaatgaagttatagtctatgagaaattacatccgtatgttggcaatcaggaaaagtttcactacagaggtacatagaaagatgagtagaattagaattctgaggggcagagatggaggtgtaaggggaagacaatgaagcccattcctaataaagcagcagaacagtagtctcagcaaatgagtagaggaaagaagcttgtcttgaaggcttaccaaatcccagaaacatatgcttttatatatgttatattgaccctacgacaacaaggaaggttaagtattatatcctcattttgtaaatatagaaattaagtttcagtgaccgttggtatccagtgtcaatcttaggtctgtctgactccacagctcttgttctttccactaagttagactgaagagatcagtctgatcaaaattaagagtcagcaaactttttctctaaacggccatatagtaaacatcttaggcttcctgggccatatggtctctgtcctaactaacctatgacattgtagcagaaagcagccacagacaatacataaaggaatgggtatggctgggttccaataaaactttatttataaaaacaggtggccagctagatttggcccacgagccattatttgtagactaccataatacattactaccataatactacctattaccaaatgaagattgtaaggaaaagactactgagagataaagctagaatttggaattatatgggaaaattaacaattattttcataaatattaggaattcactgaagacactggagcacatggaaactgaattgcacctgaggaagatcaatgtggaaagtgttatgcaggatagactggagaaggcagagaatataggtttggaaaatacatagcagattatttaagctgatggccttgcctcagatttgactgagaaaacagaagtgatcatatccgatccacttgatcttctcaccaacaaacatacacaactacctatatttgtacccaagttctcatttgcctgttaaaatgtaggatgtgtttttcctgttaccaaagaccactctctatgccggcccctcctgttttgcaagagctttgcaactttccttatactttctctcttctgtgctctctctccaggactactggctcattcattaccatataaatgtgctccaatattttctattgagcccacatccccctctagctgccagaccatttctctgctccactttatcagcaaatagacaaaggaattatctgctcatcttatctcctcttcaatccctcattccccattcataactcaactcttaacactctggcttcttccctgatcttcccctagaactgctcttgtcgaggtcaccagtaaactccattataccaaatccattggatacttctttgagctattttcccttgatctttgagcggtactttgcattcacgacactacgctgccctaatttcccacctcctgccttactggctgaaaaagctgaggaaggcttctttgctggctcttccttctctacccctcaaatgttagatgttcttagggatacattctgggccctcttctcttctgactctaccctctagcaggtgatttcaccaacatccatggattttattattattttaaatagagagagggggtcttgctgtgttgcccaggctggtctcaaactcctagcttcaagcaatcctcctacctcagcctctcaaaatactgggattataggcataagttaccatgcccatctcttttaaataccatctctatgttgatggcttccaaatttatatttctagtccagggctctcttctaaactttaggcttgtgtttcaacaatcagcttgatatttctacttggatgcctcacagatctcaaatttcttcctcaaacgtgttcttagtttgaggcttagttcttaaatttcttcctcaaatgtgtcaagcttcctcttgcttaggaatcatccttgattcctcactttaattcacacgtatgtgtggtgcattaataagtttagcaagtccggttggtttttatgtctataatgtatttcacatcttccctcttttctttttcttttctccatctccactgcaaacaccttggtccatacactatcatctcctgcaaagggctcacaagtattcttcctatttctagtctggcctctgtataatctatatggaggtagaagtgatcataatcatctcaaagtagaaataggattggaacacatcagtctactgcttaaaatcttttaatgactttctatctcacttaagaaaaacattcatatcacgtaggtctctcacggcctataaaaccgtaaataatttttcaccatctctttctccaatactgctttatcttaccctttccctcactttctagccccactggttgtccttttcttcttaactgcctccaaacctttgtctatattattttctttgcctgaaatacatctagtctccctgtgtagccatctctttcttatcctttagcttaaatgacaactccttagtaagatatatcctgatccactttcctccattataaagattgaagtctgtgaatgatttagaaaaagttaaagtatatgttagatacaacttccaaaatgttttcttaagagagtgttagcagtcacaaaaagacaagagatggcatttccttttgatctagctacaaaatcatgcatattttcacattcaaatctctgggactgagaaacaattttccctaaaccataaatgtattttttccttgtacacactacatactgcttgccagaatctactactttttccatgtccagggctgaagagtaccattagacattgatcttatttcaaaagaaaacatacaaaagttgtgggtcaggtgcaagaaatcagctcattatcaaggtcctagttatatataatatcccattcccatggcccacaattcttacctgagttcccaatcctttattacctcaaccctttgcctagcttcctgatctcaaagatacacaaattatctgttcctagtccctgattcttagtccctgatgacaggtttatcttcttaatttcaaatttactgcttactttctgatctcctggtcctggtttcttgtcctacccctatcaaatagagaaatatgttggctattacaaataaaactgctatgaaccttcaaaaaaagaaatatgttttgaaacttacagtaattttcagaaaagaaatgtctccttcaaaaattatttgccattggccgggcgtggtggctcatgcctgtaatcccagcactttgggaggccgaggtgggcagatcacaaggtcaggagatcgagaccatcctggctaacacggtgaaaccgcatgtctacaaaaaaaatacaaaaaattagccgggcatggtggcgggcacctgtagtcccagctactcaggagactgaggcaggagaatggcttgaacccaggaggcagagcttgcagtgagcccagattgcgccactgcactccagcttgggcgacaaagcgagaatccgtctcaaaaaaaaaaattatttgccatttactttaaaaaatatatgtgtcattggaacaataattttaaaacacaggagaatccctaaatttaattaagagagaatattccctctctagatgtcctgcagtaacatacagacactcctaagatacacaaatatctctaaagaaaattacttagaataggtatagaatagtgaaagagctgggattacaaattaaaacatgaaatctgtatctaataggtagtgacgcaaaggtattaatattaatcataacaacatttactgaggtgtttctagaggtgctgggctcaatgctaattattttatatgcctgatctcactgaatcctcacaatcactttctgaagtcagtattattaaataaatttcaaagacaaggaaactgaggcttagagaggttaagtaactttcccaaagtcagccacacagctagtaaatgtcaaaactggcttttgaccccagtttaactccatagtccatgctcttaaccgctatgttatactgcctaaatacagaatttcacatagatccagaagacctgtattcaaattctgaccacttcgtttataagctgagtgaccttgggcaagtcacttgatctcttcaagccttgcttttctcatctctaaaatgaagactataactccctcctaagttcatcaagtggtttcagggtttaaaggggataaagttaaggaatgtactataactgttatccactgctctataaagatatgctgctgtggttacatggcagtcttaggagcactgatggtgctttctacttgtaaggatattcccggatttgagttcaaatgagtgatgttaggctctaaccagggagagaacaatttaaataactggagaaaacatcttaagataaacataaaaactacaggaataaaaggcacatttatcctgagagcagacagagtagcaaatgttacctggttcctctggctgcatgaggtcctgttcagataagacactctcttggaggtttctctcagaacatcgtggaaagactgaattggggagaaaacaagcagaaaggccaagagtcccttctattggaggtagtgttctcctcattgaaaaagaatctggagacctctcctttaaaataagcaggttaaacaaactatttcatgatgttatatatttaatattgatataaactttcctaaaagttgctaaaatatttaagagaaagttcaaagtatgccaacactccacaacatttacttcttaataatccccaaaggctcaaaaacattttgctctgttgtctctgtatcttagttgctctaaatttcaatttggaagctttatttttcacatgaccagggaaaagtgtgtgtgcattttctctacactccctaagaaacaaaaaattacttaggagatgtaaattaacaacaactacaaaacactgatggggtatttctcaacttttccatatatgctttttcataataaaacaccagatttaacctttttacttcaaaagaaatatgctggctattacaaataaaactgctatgaaccttcaaaaaaacatgttttgaaacttatagtaattttcaaaaaaggaatgttaccttcaaaaattatttgccatttactttaaaaaacaggtatgtcattggggccgggcttggtggctcatgcctgtaatcccagcaggttgggaggccgaggctggtggatcacttgaggtcaggagttcgagaccagcctggccagcatggtgaaaccccgtctctcctaaaaatacaaaaaaattagccgggcatggtggtgcacgcctgtagtcccagctacttgggaggctgaggcaggagaatggcttgaacccaggaggtggaggttgcagtgagccaagattgcgccactgcaccccagcctgggcaacagagtgagactctgtctcaaaaaaaaaaaaaacacatatatatatatgtcattggaacaataattttaaaacacagaaggaaaatctctaaatttaattgagagaatatttcctctctctaattgaagtccttattcctttgttttcccatttcattgtttatagtatataagctcccactgctcatgaggcttaactgaaagacaaaagaatgtagcattatataagataattaagttctacagatttctgaacaacataacattgtgcctatagtcaacaataccgtattgcacacttaaaaatctgttaagggggtatatttgttgtatttttactaccataataaaaaaaagcatataacaaagtgaaagtcagtccacatgcagttgaaaaaacaattcagcattcaatgtgaggtgataaaataggactataaaaggatgcttttatagcaccattgtctatatgcaaaagttttctataatttaaattttctaatttgtgtctttaaaaaaagcattaagcttttctgaatttttctgaattaactctaaaagtttgttagcactcaactctaataattttatgtagcaaatttatctgagaagaccctttgatttaaaaagaaaacagatttttttcttctagttttctttgcagtgctagataatactattatacagaataggccacaattgtaccctctctcttcgccgcatacgtgctgatagagtcctctgcagtacatttcctgaggttaaactgctatacggcagaaaagtcgccacagataagcaagtatcatttatttcatcgaattcaatttcttttgccacaccacgatgaggagcagcaaaaactaccatgtgacatccaccacaagcaacctgcagcataaatccacagaaaaactcatcaacattggcttcaaacacaaatgagtttttaacagttatcagctgtaagacatttatttagtggtaggcttcctagacagactggcttggtgaatctctctgtctatacgtatgtgtgtgcacaatgagaatgtgtacacaatatgtatacaataggtacacaattaccatacatattctttaaacattgtgattgaaaattagaacaagtttaatccaccattttactttcaatttaaaataatatagagaaaaaaatacttggcaaattacatttctccttacagttagaaaatgttgtattttaatctgggaagaacattaaaaatgtgaaaaattactcagagaagttctactagaagattttttttaaagtataaatcagtctcttgagctaattatgtctctaagccttctttatatgaacattttctaagtttaatgcttaaaagtccttagaggaaaataaatgcaagtatgcgtgattacttgggtgatgacagaacaataaaaaatgaaatcagcattcaaagaattttgagaaataaatcattttcaagaaaatgctaaaaaaaaaacccatagtgcagtattttccgtacataggttctagatactttataatgttctatttttccttcataatactttaaaattttaaatttatatatatttttgtatatcccttttaaaaattataagactgtaatgaataagtcctcaatgaatgaggtcctggttatttcgttcatcactgtatacaatactttgtatttcttttttttctttttttttgagatggagttttactcttctcgcccaggctggagtgcaatggcacaatctcggctcactgcaacctctgcctcccggattcaagcaattattttgcctcaggatcccaagaagctgggattacaggcacctgccaccacgcccagctaatttttgtatttttagtagagatggggtttcaccatgttagccaggctggtcttgaactcctgacctcagttgatctgcacgcctcggcctcccaaagtgctaggattacaggcgtgagccaccgcgcccgaccagtactttgtatttcttatacttagcacactatcttacccatagtaggctttcattaaatgactgtcaaatcaataaatcaaagtgttccatattatgagacactgagtctctggaggacaaatttcagtattatcatcaagtaaatagaattttcaaaagtctaaacttaactggcaaaaatattaagaaacaatacaggtatgatgcgtgatggtgacgtgacactgaaataatacatccttaacctaagaaaatttagccaaaaaaccgtatcttcaaaactctttattttttattttttttgagacagagtctcactgtcacctgggctggagtgcagtgacacgacctcagctcactgcaacctccaccttctgggttcaagcaattctcgtgcctcagcctcccaagtagttgggattacaggcgtgtgccatcatacctggctaatttttgtattttcattagtgacagggtttcaccatgttggccaggctgttcttaaactcccgatctcaggtgatccgcccgccttggcctcccaaagtgctgggattacaggagtgagccaccgtgccctgccaaaacgctttgtttattatcagactttctgttgtgcaggatttgagagtctaacatttaattcagcaaatatttattaaagactattgtgagcaaggtactctgctgggtgctacacaagatacaaagcctgcgggcatggcacagtcccagctttcaacagatatatgagaatgaagcagaagagacaagatttcagcaaaaaggaagaggctaaaggaggaaaattaggagcaacacattttctgaatggcataatgtctgacatttggcttttaggaaacaagtatatttattagatatatatatgatactcttccatacaaacataaaattacttattttctatgaaatactgaaagactcaaatacagtaatatgaaaatataaacagggaaatgtgatgcccttaccaatttaactataaacctcaaaaaattagagcacaaagtaggaatgaagtgattggtaaaattctccagtccaagtcctaattttccgtggcgaccatctccaaaagtatacataaggccgatatctaaaatgcaaaaataatgaagagaattataaaagtgttacttgtatggatctatttgtaaacagataaacatgttaactcatactgcaattataattatccccctcaaattctgccttgaatttactctattgatctttccacactctctatggtctctgtggtcctgcatgtaacatcaggcaataaatattctgagaataaatcaattaaccttggtggtttgtgaagttgatgacctgtcacgcaaggcagtgtgtggagcagcagcaatacagaatgagaatttgagatacacatcatatattccaagggaaggagaaggagatgcttgtattctgacccctacatcccaacacagtctattttccttttccctgaggtcactgatagatcagagtttctcaaccttggcattattgacatttggggccagataattcatggtcgtgtgggtctgtcctgtgcactgtaggatgttcagcagcatccttggcctccacccactaaatgccagtaggacaactccattctgcagtcatgaccattaaaaaatgtctccaaacgttgtcatgtgacttggggagtgggggatgcacaaaatctctactactggcttagcttaactaatctggctcctgggctgtggaatactgttgaagtaaatgccataagccaaaaatgctaactaattcctataccaaaacctgggtcccctctgaaactgggcccacaatgatgatgagtaatcttgtcacttctcgccagttagtccttttgcttactgccatagcagctattacgaaccttcacactcctttcttcaagccgctccatctcaactggggtaagtgccagggaagcagaagtaaggggtgttaatatggttcaaaggaggggaattttcctctagtctggggattagggaaggctttcaaagggaaacctaaaggatgagtagggcttagctgcatgaagaagggagcaaagaatcttccaggcagagtcagcagtacatagaaagcctctgaatcaagagcaaacgtggctcgggcaagaagctgaaaggcaactaatacccctgaagcactaaggggagagtggtaggagatgagtctgaagaggtgaaaagggactacacagagtgtcctattagttcagatgaaggatttttgaagttttatcttaaggacatttagaaggaaaatgaatggttttaagctgggaaacaactgggtcacctttggggacttctggtttaagacggcaaagtgactgcatactaagcaaatccaagagaactgaaaaatcatcagaaagaataatataattcagtaaggtggcaagtataaaaatcgatttacaaaaataagtagattccctgtaaatatgtaagtaagtgctattcagtgtttggactctttagactacctttttttttttttctttttttttttgagatggggtctcgctctgtcacccaggctggagtgcagtggtgcgatctcagctcactgcaacctctgcctcccgggttcaagtgattctcctgcctcagcctcctcaatagctgatattacaggcacgcgctgccatgctggctaatttttgaatatagtagagatggggtttcaccatgttgaccaagctgtagactcttacaattcttactattaagtatttatgtccttcttttatatctgctccttatcacctttatcccttcttcctccttcttttcaacctgatttctttacccaaatgttttttaaggtttgccttttaaatttgattgtcttttgcctgaaaatataaaccctgatccaagctgcctgatggcactttcaacctcagagagcttttaaaaatatgagccactggctataatggggaactggcaagagcttgcagataacccactacatacttctcattagtcctggaggaaaaaaaaaaaaaattccacaccacttgccctccagggacgattgatgaacaaaaaggcaaacaaagttaatgttcaattatttgtgctataactctttttatcaggagtaaaggtactatgaaaatttaactaaatattcgaattgtatgttagatgacagattaaaaatagtatgtatctactattagtggaagattagagttgatgaaaaatgacagtaaggacagataaagtgacattaggaccctatagttaagggatacacaacaactcttagtggatgatgaatgaataatacttttcatattctatataatgctatttcatgatacattctcaagaacactgatacttgatcatgggcaggtcatcttctctgaaagcttctttggggaagaagaaacagtatatcttgcatttgctgattcctagtttccctagccagataccattagatgagcagtagttttttcaggagctttttcatagcagtagctttttcaaaaagaaggaaaaaaagtagaaatactagtacatggattacgtcaatacactagatgatttctgactttccaatgcttcacttcatatttagacagaaatagtgaaattatatacccgtttgtcacaaagcattgaaaactgtggactatatcaattacctacatatatgtgactgaatcatttaggggagaatctttactgagtcctatattattagcagcacatagttttgaggctgagaagtgggctcaaaggaacatttccctgcatgaaggagataccacagagtggaagaaggtatccacttagtggtctctgagggtcccttctctctaacacgtagaaagagaaggaaaggagtcattcctgaaaacgcctccaggtggcaaaaacataacaactgactcggcctgaatgcagctctgtcagactgaataggaagaatgttttaaaataagtttttgcttgtgggatttttccttttggcctgagtagaattaagagccttcaaaatgatataatttcaaaaagattcctgttttctgacaaagaataatactatggtctaacttctgacatcatcggcctattgtgaggttctaaatctttggatcatttacatttattctaaattgaattaaaataataaaaagttcacaactttatactttggaatagtaaacatggaattccatttttctcagccattaattcctttacttaagttagatacattcatttcacatataatttattttgtaataaaatatacccagttctataaatatataacagaaattctaatccatacctgttatcaaagctgtgtgattttctccacaagaaatataacttattgtttgatccctaatattctcaatgactttgggttctgaagtttcaaaaagaaaagtgccaagacccagctgaccaaattgtcccagcccaaaggtatacacagcattctctgaaaggaaaggggcaaatacaagacaaggattatggaagcagacactgttaccatcatatctggaaaaactgtcacgttcaaccttttatagtgaaggttaagtgcctctggggaaaaaaaaacatttaagaatacttaatattgaagtataaatctttcaatgatgaaggaagagaaaaatgaaaaggtacatcattataaaaattatgacatgggtatgattttatcttttatacataaccatagttaggtaagtaacaggtatgatacaaggcacataagtcagggaactacctgaaatgtccccataattacgtcggctcaaaaagtaccaactgttggccggtcgcaacggctcacacctgtaatcccagcactttgggaggacgaggcgggtggactgcttgaggccaggtttgagactggcctggccaacatggtgaaaccccatctctactaaaattacaaaaattagttgagcatgatggcatgcatctgtaattccagctacatagggaggctgaggcacaagaatcgcttgaacccaggtggcagaggttgcagtgggccaagattgcaccactgcactccagcctgggtgacagagcgacactccatctcaaaaaataaaaaagaaccaactgtcattaagctaactcactacgtcaaataaaaaagtgaatagtgtctcctacagaaaaacttcttccttttaaaagcagtttatgcatcacctaaggtcaggagttggagaagagtctggccaacgtggtgaaaccctgtctctactaaaaatacaaaaattagccaggcatggtggcgtacacctgtaatcccagctactagggaggctgaggcaggagaatcgcttgaacccaggaggtggaggttgcagtgagccaagatcacgccactgcactccagcctgggcaacagagcaagactccatctcaaaaataaaataaaataaaataaaataaaataaaataaaataaaataaaataaaagtagtttaataatctatcttataaaacccaatttcagagaattgtcttgagaattaaaactgatagggcatatgctagatttattcacaagtaaagcttcttcactaggaaatgcaactataataggaggggaaaagcttttctttatattgatattttgaagtgattccaaaggacttccagtaactcagtaaatactacgtcatatgttttctagaaatgaaaaagtacaaaaacaggatacatgagtggtgatgaaagggtccttttagagacatcatgctcctggctgctgcattaggaagcgcagtgtcgattatattagtcacttctccttagtacactgagttttgtactttgagtttagtacattgagtttctcctattacagcaggaagggcaagagcttgttattcaggccagaacccaaacattcattattactagctgtggcaagcaggtgagttacttagattctctgatgttataatccctatctaacagaggtgctgacaggattaaaagagaaaacattcaggcagatttgaaaacataatatgacatactgttgtaaagaacatttttctaaaaagtatctaatcaactcattctatcaatgggggttacaaatgaaaacataactgtctattgtcatgtggttttacaattttttctaataaaaatgtttgcttcataaataagacatatagatactactcctttaagaaaatatgctgtatcaaagatatgaagccatattgaggcaatggcaaaacagatctttattttaatattaaaaaaccatcttagtttaaataataatcacatggcatatttccagttctaaatgttcagcttaacagtagaatattgggtaaattaaagcaattatctatctctagctgaccaacaattactctacatttcttaggctgtctgattttaattagcctgtgaaatgaggctgtttaggcagtctgaatcatgttacagaagttttgttcagtatcctggtaggttcccattcaggtgcttggatattagtgatgacagcagtttctattttataaaaatgattgaaggcgctcttatttaaggacattatatttaacaaccaatagaatttttggccatatcacctttgtgacatttaacaacataatttaatgttaataaataatattacattaggaaaatagatttgatcagttagcttcagattaatattactgtaatttcacagaatatatttgatttcagaactaataatttgttaacctgtagaaaacttaggtttatccaaacataatctgagaagttaagataaattctcatttgcctcaggacccagacttcattgtgaaccccatctcacaactggcctttcttgtgtgttggtaactgctgtggacgatttacaaaactacaaatatcactctgcctcacttagtgtgtcccaagttccagcctcagactttttccacagtggtccatggtttccctgatcccaaggagaaactataatcaccctatcactacaaccagttttattttctaatctatcacggtcatgtgcaaatattatgttttaaataaattcatcagaaatgaactaaattgtttttaaaatagtttaatgaatgatcctctaatagatttttaagataagagttatagacttttgaaaaacaaggctgggaaggtccttcacagaaacacctaatccaagtgcttttctttagtgaaagaaattggaacaggtgattagctattctttccttaaggtcttacaaaatattccataactctcttagcaatccagtttagtatttagtcacactgatgatcaatatactcttcaggtccatttcttcatcagctaggactaaatatttttaaaattctgcctatactgtgctccagaaccaggttcctcaccagggctggctcataataaagctctcacaggtccatggagaaatgtgaaaaacaggcaaagtagtgaaattttcatacatatacatttatacagtttaaggaggtgccctttattatatacaattaagagttttttattttgaaaatgttccttattttatgatatgatagtgcagtcatgtttttcaatgcccatatttaagcaaacgtgaatcagaagctgacaaccatctattggttctcataattttttaaactcaaattttagattattctctggattgtaacacaagctcttcactgtttacaaagttatttatgaactgtaaaaattatctctccatgtttttttccctgtattaccaagtttttctcctgtattcccccattcaatgttggctgccacaatcagaaaggaaatgcaaggacacttctttcttgcatctgtagtagaaatcttagtggcaaaaaataactgttccaggtctgtcaaatagatgcatctcataatttaaaaaactttactggtgtgtgagatccgtaagcttgcaaaaatctggagagagcaatcaatttctggaaacattatacttaagctcagaacaaagtccacagaaagttaaatgtctttaaaaccacacgaaaatatcatccttaagtgcatttattttaaattaagaatttaaaattaagaattgagctttcattaaaagtatcatagattatcttgttgctctttatagaaaaatgttttataatgaatggttaaagacactattatacaatcaacatttgtatctgttaaaataaccctgaatgacctattaaattaattctttctatagtctttgtataaactagagaaaatatataacacataaagttgcatttctgcctatagaatgaattttcagataatgtgtaaaaattaatttcaaagtttaatttttagaatattttcgaaattatataaaattcactttttcagcaggaattcaaaaacatcttaaacctcagaattatttccaaatttagagtataagttttgaaaaaaaattatttctaacttagaaaagattccatctagaaactaaagcttaataaccacgactggggctagaacaggaagctgaggaaaagtaacatcagagaaaaaaacataaagataaaatattattcacttacctggcaacattaggcatatcatcttagaattggatattattcaaaatttgtctacaacatttctaactttgggctactaaagattaagtggtgacttcacaaactgttaatttttttgtgcaaaaaatataataataattcactacctaattgtattatgtacattactcatctaaaataaatctaatgttgaaaaaatttggaagcatcaatttagtaaacatattagcaagtagtgagtatatttcaatacagtgattagaatcctgagaaatgacatgtcataacaaatatgaaattcagatcccaaaagtaacattaaggtcctaactttcttttattatctgtaatttaaaaccataccactttttaatgaattactataacagaacatacaactacaaagaaatccccaagctacacattgtaaatgtcacaaagaaaagaattatcaatgacatatagaaaatagcttgaacaaaaagcttctccaaaagaaggcatttcaggaaaaatgtcaattttagataaatatagaaaacatatacatgagaaaaattgtttgtccctgaaaatgagctaaaaataatgtaatatgttgccattaaaaatgttaaggtcaggccaggtgtggtggctcacgcctgtaatcccagcactttgggaggccgaggctggtgaatcacctgaggtcaggagtttgagaccagccttgccaacatggcgaaaccccatcactactaaaaatacaaaaattagctgggcatggtagtgggcacctgtaatcccagctactcaggaggctgaggcaggagaatcgcttgaactcaggaggcagaggctgcagtgagccaagatcaggccattgcactgcagcctacatgacaagagcgaaactccgtctcaaaaaaaaacagttaaggtcatgaaaatgtaaattatgttagcagaaacaattcaacaagattcattttttttctacttaaaaaaaatattccatagaccagaaatgtatattaagtacaggaataaagggtgagaatcttttttttgtttgtttttctttttgttttgagacgaggtcttgctctgttgcccaggcttgagtgcagtgggacaatcacagctcacctcaagctcaacctcccctggctcaggtgatcctcccacctcagcctcctgaatacctgagaccacacctggctaatattagtaaagatggggtttcgtcatgttgctcaggctggtctcgaactcctgggctcaagagatctcctggcctcccaaaatgctaggattacaggtgtcagccattgcaccaggtccaaaaagtgagaatcttaatggaaagagatgcaaaggccacctgacacgaggtatctaagagtcaaactcatagaggctaataataaaatggtggtcgccaggaattgaggggaggccggaaagacgagttgccgtacagtgggcgtgaagtttcagttactcaagataagtttcagagatctgctgtacaatggtcgtgcctatacataaaaatactttattatactcttaaaaatctattaagaaggtagttctcatagtattcttaccacaataaaaaaatgaacataaaaaaaatgaacattaaaaaaatttcattagccaccacagaacgcagggaacagaacagtggactccacacatacccgtgagaaccacagtatgctctccaccacaggctacttggatcaccttctccggaatttcagacaccagctggggtgttctgtgattgcccaggagctgattgggaagacctaacttcccattctcaggttctccaaacacatatagctcaccatctgctattgaaggaaaagtatagtgattagtgatgacatacatatgaacaaaaagctggtcttaccgtcaaaaaaaagttttgacaaggatcacttaatacatttgacctttcttgagatatttttactgtatgataaagaaataaagctagattttcttttccccttgattattttaatccaatcattttcatgaaaaattcatgactaccactactaataaacaactagaaaattactttagtgctttcacaaaagtgaagaatatcttgtgtcttttacttacttaaagctcccataaaaacatgaattttgtcttgctccctatggtatccccaaaacctagcagtgtctagaacaagcacttaatatttgtggaataaatgaatgaataattgctttatatgaaactggttttagaaaactcacttatgtgtgcagtaaatatgttaagtaaatcttaagatagcagattttacccatttagatggcacttcctccaaagactcttaccaaggagttcctgacacttaatcactgccctgtccatactaacgctattaatttgcttctttattacatttatcacactgtattatgactgtgaacttcttgaaagcaagaactttcttattcatttctatgcaattaactgagttctataaagtagaatttaaaaaccttgtgtaagtatatgatccaatctgaagaatgacatggaacatatcaccattggtataagcaaagagacaacagagcagatctgcttgcttattctttgcaagtctctgagagaaccatgattgatccttgcccaacccctgagaaggtggcccctggagtgttctttatgtgaatgattaatgattttgttatatataccagagcaatgaactatgccagattaggtttgtcagggctgcttgcacaaacatcaacattgatgatgtgcacctggcttcattattgagggtcctgagtttcagctgctgtggccagttgctagcaggaggtgcctacatgaccagccccctaaatcccctagaagcaacagaatgggcttccctgggcagagacattccacacatgtccctgtagttcactgctaagaaaacatgccctgtgtggtttcctaagagaaagtactaggaagcccaagcttgacttctctggactccactgcagatgcttatctttttcccactttttctttttgctttgtatcctttgctgtaataaatcttattcgtaagtataatcgctattgaagactgtgagtccttctagaaaatcacagaacttcaggaaggtgtgggacagccaatgcacaagatatgcaccacttagaacttgctcaaatactgtaaacacagctatattgattttctgaattgatctgcacagaaaatgaagttttatggaccacagttttctatgaagtatttagcaaacactggcacaaaagtggtgcccagtaagttagcacccttccattttcccatgcttgttgcctcccataggaaactggttcctaagtcctgatgagtctctctccatttctgtctatagattcctgattccctttacaccttaacatgaattttcacctggatcaagttttccaaatgtctttcctacctctagtctaacatacccacacaatatcagatgcatcttccaaaaacaaggctctaattatgacacttccaaataaaaaaaaaatacatgtatcaagtacaaactgcagactgttacaagagaccttccatattaggttcccggactactaaccagtcatatttctatctactccccaacctggtgactctcttttgagtcacatcctcccttgggaatttgatgacagctctataaaaaaagtacacatcccagcagggtgtgatggctcatgcctgtaatcccagcagtttgggaggccgaggctggtggatggcttgagtctaggagtttgaaaccagtctgggcaacatggtgaaacccagtctctacaaagaatacaaaaattagccgagtgtggtggcacgcatctttgtcctagctactcggaggaatgaggtgggaggatcacttgagcccagaaggtctaggctacagtgagccgtgattatgccactgcactccagcctgggcaacagagtgagacctagctcaaaaaaaaaaatgcacctaccaaatttagcatatcatttcaggggtttacattcctttaggatccatgatccctaacctctaaacaaacaacctctaaacaaactcaactatgcaataatctccaaatacatgatttacttttctgtctctatatctctgcacatgtttttgtctctgcctggattgttcttccctcatctctgtctctctcagagttgtttccatctttcatggttaatctcaaataccaccctttctctgaaatatgtcctgacgcccctaacaagaaataatattttttctttcttgttctcacgtaagactctgctatcaaatgtcttacgttaccaatcatggtctgctgtatattgcagttattggtctagcacagtagcaaaaagtatgtgctacagagtcagactgccttgtttgcatgtggattctgccacttactgagtcatactgagcaagttgttcaatcactgggcctgtaacatggggataaaagtgcctatgtgatagggttgtttcataggaataaccgaattaatgcattcaaaggcacatagaacacataatcagtgcctggtcattattagttgctaccacatcctcctcttcctcttgtatatggagagaaactgcatgtcagtagaaattgttcaggcttttagaactggaagactggagttcgaattctgattctgcaactcaatcgcagcatcaccttgaataaaactgtgttctaaacctgcctgcatatatggaatctcagataccaccacctctctcccagagtggttgggagattaaatgaaatatattcgtacttgaaaatgctttgtacatggaaaaactatacatcctatagtttgactgtaaacttcagaagggtaggtactacattttaatcaacttggtattgtaagaaatatcatttaaaatgacttttacatagtaagttgatgaagtttctcacagtgtcgactttttaaagtaaaatgttttacctataaagcaggggtgtccaatcttttggcttccctgggccacactggaagaattgtctttggtcacacataaaatacactaatactaacgatagctgatgagctaaaaaaagaaaaggtctgtgcataaatctcatgttttaagaaggtttacaatttgtgatgggcggcattctaagccatcctaggctgcgggttggacgagcttgctgtaaagggttagaaaagatatttcctgtagctatcagtaggaccttccttaaaggggaaggtgagtgcttttaatccatataaaatgttttatttaattccaaggtatttttcttatttatatataaaaaataaaataacatttatcacaaagaataaataggtcatttcatatcaattatatctacttcacttaggcctattaatttttataaaatctggattcctcaaactctctacctggctctgacagctaccttccccaggattctgatcttaagcacactgccaagtctctattctccagtatctgaagattgctccacaaattcctgcccccagttcccataaccccaactcatttacttatatcccctattgtactacacctaattcagtgaatcactggttaaaatgctcagacccaaccattaacatatcagatgaaaagacacagcaatcagggataatacctgaaaactccatagattttatttatctataagatctaaaaattgaatattttatataatttataatatgaacttgaattgagaacatgaatttaaaacacgaacatgagcatttaaacatattagtaggtgaaaaatctgtaggaagtcttaaacataactatcttagtaatatgttctgtatttttattaggaaataaactattctgtttggaggttcctcaaaaaactaaaaacagagttaccatatgatccagcaatcccactgctgggtatatacccaaaagaagagaaaccagtatatcaaagagatatctgcactcccatgtttgttgcagcactgttcacaatagccaagatttggaagcaacctaagtgttcatcaatagatgactgaataaagaaaatgtggggccagacgcggtggctcacacctgtaatcccagcactttgggaggccaaggagggtagattacctgaggtcagaagttcaagaccagcctgaccaacatggtgaaaccctgtcgctattaaaaatacaaaaaaaatagctgggcatgatggtgggcgcctgtaattccagctactcaggaggctgaggcaagagaatcgcttgaacctgggaggcagaggttgcagtgagccgggactatactactgtactccagcctgggcaacagagcaagactctgtctcaaaaaacaagaaaaaatgtggtacttatgcacaatagagtactattcagccatgaaaaagaatgagatccggtcatttgcaataacgtggatggaactggaagtcattacgttaaatgaaataaaacaggcacagaaagacatacactgcgtgttctcacttatttgtgggatgtaaaaatcaaaagaaactcatggaaataaagagtagaaggattgttaccaaaggctagaaagggtagtggggtgtgtgtaggagggaggttaatgggtccaaaaattagaaataataatttctagtatttgatagcacaacaggatgattacaatcaaaataattgtacattttaaaataactaagacagtatcattggattgtttataacacaaaggataaatgcttgaggggatggataccccattctccatgatgtgattattgcccatcacatgcctgcataaaaacatctcaggtattccatatatatacatatatatatatatatatagagagagagagagagagagagtacccactaaacatatatctgtagtacccactatatatatattatgtacccacaaatattaaaaattaaaaataatccattttttctgatctacaaattcaacatacaaagagaaaaaaataatgcttttctatacaacattttcctctatcatgaaatacatattaagtaaaaccccttatacttgagttatttccaaaatttataaaaagttgctttaagtgattaaagtcataaaataatggctagtgtgaaaattactgacagttcatatcagctgatgtaaatgaatctcagcaaaatgcttagtataaaagttcattttatgtacaaacctgtgaatatgctaaaagacattccattgtacaccttaaatgggtgaattgtagggtatgtgaattatatctcaataaagctgagctttttttaattaaaaaaaggcataaaaacaaaccaaaaaaaagctcaatgtaatgcctgttggttaagatgaactattccacttgttcacctaacggctaatgcagagttcattcacacaattcattcaggcagttttcttaaagcccaaatatgatacaatgcttttacttggtatttttgttgtttggttggcttattttcccatttgtgtttttgtttcatgaacaaagcgagtacagactataccaaccccaggagccaaaagttgccaataagttggtaggtagtgttgcctcaaggaatgcaatcaattcatcatttattcactttctccctcattcaataatatttattgattatcagtttgttcaagacaccagggatgcagtggtgaaaaatactgacaaagtcaggtttactctctcttggtatcatgctgctaccaattcattggtaactttagggggcagtgaaatgggtgaattaccactttctaaccctgagcctgtggtatatggaataaagagtaaatgtataaaataaatatttaaagatttgtctaagagggtccataaactatttcctctaggtgtttttactgttgaaaaatcccatcaattagatggaaagtcataatcacacttcctctattattactagtgtagatagatatagactataacagctagagcccaacatttccaatattttaactaagacagaaaaggttgccagtgggtccaggaaagggagaagttgggaatgctgagaaagtcccaccaaaggaaactatatcccatgctgagctctctatattcacctaaaaagtgatcatgtcagacagagtttgaaattatgaactcttattatataaatggggaaatactgtgacctaaaacagaccaaaataatttcattacatggacaaccatggcattatttctatagaaccagagactatatcatttcattattaatttaataacaacatagaagtgggagataacatgatgacttcaaaatgtgtcttacttgttacaaaagctgaatggtaatatccacaagagatccaggagacaggtttcccaatggtcacttgctgagggacacagacattacttacattttttaaaccaatttgcccttcggaattgtcaccccacataaaaagtcttccatcctctataaagaaaaataaaagggggagaaaaggttttaaaaggtagccaggctctgaagctattatacttccaaaagaccatttattttattagttcataaaaattatgtatcttaacaataaagtactactaagacatttacaccagctagctacttaagagttcaatttatattgtgaaatgcttctataatgataaagaacacagaacagcctgattgtaaatcacttaagtcctgaccatatttttatctcgatagcaaagacagaatgccctttcctacaatcaccctttcccattctgatgtttctaaacagaaatgttctcctccttccaagcagcctacctgcaactgaactgaaagacagcacaggtcacattagacacctgcaggtcaaaaaagcctggaagaccttgctcttgggagcactgtggaaatgatgttttgaaaaaagaacagaagaaacgtatttcactacattttttttccttataatttaaacctgaaaacacagaatctagcctcagagaatgaagatacaatagcatgtacagcatctcaaaaataggtaacatataatttctgataagggttttgatgtcagaaaaagttaatctaggaaaaatattttagaaaggaattattaagacttatttatttatatattttaaataatttacatttttgaagtattttaataatgcaaaacaaataaatgaaaataagaactgaaagaaggatgtcaaaatgctaacttaagggctgacaaaatctaaaggactgagcctcagagacaactctgactttcctgatagagtaacaccggatgttacacagtctcctgcttgaaacaaagcagctaaccagcagcttcagtaagatcaagctgatcttggctccaaattttaaagaaatgtctcatatgggcttttggtagggagggcagagaggtacaatgaccgttgcaaaccacattttaacaacatatgctgcaacagatttctgtggatgtttctgacagcaacttcagttaaaactgcaagtataactttaagagcacacaacaaaaataatatttaagaatatctaaaggagtagacagacggcatagcttagagcttatttgccaattactttttaaatgtatatttaaataagcacaaataagcataaaataagcataaataagcataaaattgcagtatgtcaagatttaaagttatattttaaatgttttctgaaagcacatagatagtcgatgaaagaaaactaaacagcaatgctcccttcggtttactgagttggcatatattgatctacaggaaaggaatgtgtcccagactgaaaaagaaacaagtctcaccagttagggcagctgaagtattagatccagcagacagctgcttaatcttatgctcggatgtaaaaaagctaattacatgaaaagtgtttctttcttcggtgtcaccaagccccaactgtccttcattatttccaccagttgcatatacattgcctccttctgcacatggaaaagaaaacgtcaatagactatagagtccccctttttatgagacaggtcagtgtatagcagcgatttcctctattaacagtgaagaaagttgaaagctatcactatcctattatttgggagacaacttcatttcatcgtcaaaataaagcaaaacaagcaaggccacatatttttgtgagattttagaaatcaatctagaatgtaactagcaactgaaatgaacagaatgcatggaacgtatttatttcttgctaatatagcactttattaattcagagtaaaaacaaggaaagtaacttccaaactagtttaaaatgcaaatctattttaaaagagatgtgtccattaattttaacttctgtaaccattaaagctaagatataatagtacaaataagtaaaacaaggcaaatccaagaagaatctaattagaaacatgataattctttgtatttattttaacttcctagctaaataggaaggcactatagcactctgtttagcaggaaagactccagagccagactgcttgggtgcaaattctggcttaccacttaccaaagctgtgggaccttgggcaagccataacctctgtgtgcctcattttcctcatctataaaatgaggataataatagtacctacttcatagagttgttatgaagattgaattagttgagatttgtaaaattcttagaacagcatttggctcatttaaagtatgtaaaaatgtttgttaattactctgttaattaaataaaaagtacatcatgcctagattataaacatttccagtaagttgtaaattaatgaagatttgtaacacataaattagttatgtcataaatatataaatgaagttaaagccttgctaaattataaggtgaaatgagggcaaaatcagcctgagttagtaaaaattttaaagttattgttatttttattttttgtttttaggaaaagacgaaacctaattggggaaacaagactagctttcaaatggaaaatacaaggtcacatgcaattggagtgcacaatttcacacacatggagcaaaccagagttggtgagatgctgaaataattcaaacaaataaatgaacacacagtcacaaaatgttccatgaaagaagttaacacttaatgggatctcaagaaataatcttaaaaggctaagagaaagagaaaagacacttcagaaagggaaaggtatggagaggtggagaggagctgaggcagtgaaaacatcctgaagacagaataagtggtggtgggggaggggcggggcaaggggcaggggcagggggaaggtggtaggaagtactgctcagtggtcaggtcctggaggtctaaatgttacagcagcatttgctgaagatactatcctttctctattgaatttccttggcatctttgccaaaaatcaagtgggcatatacatatgggtctaattgtagactctattctgtttcattaatctttgtctatctttttgccaatacctcagtcttgattacagtagctttacagcgagtcttgaaaccaggtagtgccagtcctctgttatttttcaaaattgttttggctcttctacgtcatttgcttttccatataaatttcagaagcactttgttaatttctacaaacacacacacacacacacaaaagctcatatggattttgatgggaattatgctcactcacatcaacagccttctgggtgccttccactcacccttagtaaggaagagagaagagcaagaacaggaataaccagcccttaaggtggacacacaggttaggagatgctgtcccatgatagaatccaagaaaagaagctttttcttcagccatttgacatttacgtgtatatttgcaaaggcaaacgtgtactagccattgacattttaaaaaaccctaattttactgttgccaaagtataatctctattaattttacaaagccacgttactggaatgagacctcagttctcaaagtcaggcaggaaatcatacaggttgagcactatacctgttgacaccagggtgtggttccttccacaggcagctaatttcactttttcaggttttagagctaaaaatatttaaaatgggacaattattttatagcaatgaaaatgaacagtagtccaggacaaatggtaactaagtgatagaaccgagatttaatagcgggcttgtctgattccaaagtcaatgttcttaacgagcaaaccagaggttttcagaactggttgtgtaccatcataacaagtggagctttgaatacaatatagatatcttagccccacccctatggaatctgagtcagtgggtctgaagcagcggctaggcatttatatatataattataaactccacaggtaggccgggtgtggtggctccccagcactttgggaggccaggacaggcagatggcttgagctcaggagttccagaccaacctgggcaacatggtgaaaccccttctctacaaaaaaatacaaaaattagctgggtgtggtgatgcatgcctgtagttgcagctattcggggagggggtgctgaggtgggagaatggctggagcccaggaggtcgaggctgcagtaagcagagatcacaccactgcactccagcttgggtgacagagcaagaccctgtctcaaaaaaaaaaaaacaacaacttcacaggtaattaatatgtgctgagacccactgtattctattatgctgcctcctcaccaatctgatccattacctaacctgccatcaccattatcaagctcaccttctaccacattcaatgaaaaaccgaagaccaatattgataggcatacacctatcagtcaaagttgttcattcattcatctacatattcaaaaaacatttaaagaacatctcctacgtgcttggcataggggctgcaaaaagatgactaagatagaatccctggtctcaaggatcccatagtctaaacaatcctgttagcttgtctattagataagatatttgagagtaagggtcatggtcactgtgactatcctcaggtgtttagactatgctcaataaatactttttgaacacatggaatactttaaaagttccataacaattcccataaacagcatgaatatgataagctacactgaaattttgagctgaaattaaaatttagccaggaagataaaaaatactgctcttattgcttctcaaggaatctccatcatcctttcaagtttagctgatgttcacaggttatacccaaacagaggttttgcatataacatccagaaagctttgtaagggtattatatatctaatattttctggaacactcctgatttcaaatattttgtcctgttgttcttttacactagtactaatcaatccctagtctcgatgtttcgtttacttcacctagtcactatataaagcaggataagtatgttttataaaaccagcaaccaaatagaagcataatgtccacaactgtattaaatgagaaaagctcaaaattctaacatatgtttgttctctgtatatacaataacagtaatatgtaagtagttttacaaactaacaaacaaacaaaaaaagatgggggatattcaaatgcaatactgtaaaatcattacttcctttgtggtccctggatttaaaatcaatctgatttttagaccctaacatataaaagcagttctgaatatcatataaaagataagttaaatgctaataatattcaagcaaatgtcagaaaataaagaactaaaagctttattatttatgacattaaagaactacacagtcaacataaaaatactttatacagtttgtgaaaagataaaaagatcccaaacctttgacacatgttggcttgctgatggctgactttgatcctaatcctaactgaccccagttgttactgccaaacatgtaaagtttattatttcctggtaggagggaaaaagaaataatcaattgaagcatttttcacataatgtaagatgaggtcaccacaaagcaataaaaagctatacttttaaaatgtcactgcttttctgtgttgaaataagttaccttgttcatctatgtataaccagtttctattaggtggaaaagagtttctaaaattatacggtaacaggtttttttaaaaaattatattgaaatagattcattccaagaaagttgtgtgtatagaaaatcatacttaaatatactaaggaaacttaaaatttaaaagatgctcttgatgacttattttgtgaagaattctccagcaaagtaaaaaacaacacttttgataatattttcaacatgtttaaaacacagcagcatatctataacaaaatatttagaattttctaagtattactgtccttattcaggattgtaatactaaccggtaacaacagcagaatgttcatctccacatgaaagatgtacagggacatcatttttaaaccagaatttaccgggattattttcagcaaatttacttttcccaaatgtaaacacagcacccgaatctgcaaatataagacggtctttattttataacttttactatgttgcctgttattaaaataacttttgagtaatttatccatacaaaccccttgtctcatgacagctttgcccccactctggcaatgtttaagccttccttcttccaccttaattcagtctttcttattcctcagactccattctagttttatctatgaaatctactaaattgaacatgtattactcatatactggtataaagtaagaaatatactatcacaaggaaggcagtcatctattactaatagttctgctgtcaccaagtagatgtctattccctggaatgaaatggcacaatctgtgctattcttgttctagttaacacctcatggtctggcctctgactgagagcttttctccacacacagaaacaggacagtatttcgtttcctcattaacatcatcaggctatccatggggagagtctctatcagtcaatttggattttctttggtccagtttttccaaggaacctccagtgttctcatgtaagggaaacaatgttagcccaaatggtgaactctttttatttttgttgagacagggtctcactctgtcacccagcttgaagcgcagtggcacaatcacggctaactgctgcctcgacctcctgggcccaagcaatcctcccgcctcagcctctggagtagctaggactataggcgtgtgccaccatgtccagctaaattttgtaatttttgcacagactgggttttagcatgttgttcaggctggtctcaaactcctggtctcaggctcaggtctcaaactcctgggctcctgcctcggcctccctaagtgctgggattgcaggcgtgaaccatgacacccggccaaaatggtgaactcttaatttctctgttggtaatcccaatgaatacccataaaaccggagacagcacagagagaaacaaattactccaccactatctctttcattcgaactaagggaaagcagctagaaaaaaaaccataggctttaaaggcaattaggtattcaaaggttgttgtaaggattaaatgagatgacatgtataaagaacttagcccagagcctagcatcctcaaagtgttagctcaatagctacctctgtaaactcttcctctaccataagagttggaaatgatcactggcttctctgaactacgtgatctgtagaatttatatggcaaataattgtgctacctagcaatctctctaatcaaactgttacacaaatcagcaagatttgtgtaacagtttgattagagagattggtaggtagcacaatatgtaagatgaggtcatcacaaagcaataaaaagctatactttaaaaatgtcggccgggagtggtggctcacgcctgtaatcacagcactttgggaggccgaggcaggtggatcatttgaggtcaggagttcgagaccagcctggccaacgtggtgaaaccccgtgtcgactaaaaatgcaaaaattagccgggcgtggtggtgggcgcctgtaatcccagctactcggggggctgaggcaggacaattgcatgaaccccagaggcggaggttgcagtgagccaagatagcatcattgcactcaagcctgggcgacagtgtgactgtgactccgtctcaaaaaaaaaaaaaaaaaaagtcactgcttttctgtgttgaaacacagagttcaccatttgttaccccaaatgttgtttttttccaactattttctaaggttacagagggtatgcactacccatattgcctagcacaaagtagcccttgtgtgttctacttttcacacagaaaaggtcccccttacacacatgtatattcgtaactgttgaatgttttgtttaccaattcatcataatggagagtttgtagtcaaatataactttcaacattgttaatataaaagacaggttaccaagtcgtcaacaaaggagcactttagcttttcctgatttctgagaattcagaatgtttagggatccagttataaaatgaaaagatcctctcaacacagctactcaggaagtttctaattctcatcttactcatgcactatagttagttatagagatgtctttttctctttccagaaacagtacatgggaaaggacggtttatctttccccccaaaacatcatcacaaaatgccacggtcctaggagattgggagaggagtacatggggatgttgagattttaacattcttacatcaagtcattacctgatctgagtagtattcacaaactgttgtggcacagcgtcattttgaagaaagactaaaaacccctaccatttcccaataaccatttaaacacacacatacaccaaatagtaggccaggtccagcttttggggaaatcccaaggtgggtgatcacacataaactaattcgtaccagaaaggaaaacatagcgaatataagtattaataataaatattaatacgcaagagactagccactgtggacaactttttgagaaccactgtgaggcatctcagttccaactaataattgagttgggagactaggatctagaacagactctgagtttccccagaatgaattactttaacattttaactgttttgtcttggctcccctggcttccctgataccctcatcccaagccaaggtttggtggctctgctctggccctgtaatatctactgtcaatttatatggtcattttgtttactttcctgtatgtctcactaaattgtgaactgcaggccaggaatgtcagttccggccaggagcatggaagaaaacatacatatttcagtgaaggtatgattctgctcaaacccagtgttttttcaaaatggtcgtgacctattagtgggccagaaaatcaattcagtggatcacgatcagcattttaaaagaatgcattatcaaaaaggtgtgtgtggaatctaagtggatagaacaaggactgcttcaccagacatctatttctgttacacggtatatatggagtatcgggtcacaatgtcaaaagtatttctaactatggagctcaggaaaaaaaaggctaaaaaacactcgctaaagggtccctcttctccctctttgtccaatttatttcctgtatccccttttaccccacagccctgatcactcactctttactgcattcaatacataaccgggagctcaggacctccaaagtgcacaagtctggagtccgcactttggggagtttacagaaagtgtccctccctggccgggcgcggtggctcacgactgtaatcccagcaatttgggaggccgaggtgggctgatcacctgaggtcgggagttcgagatcagcctgaccaacatggaggaaccccgtctctactaaaaatataaaattagccgggcgtggtggcgcatgcctgtaatcgcagctactcggaggctaaggcaggagaatcgcctgaacccgggatgcggaggttgcggtgagccgagattgcgccattgcactccagcctgggcaacaagagtgaaactccgtctcataaaaaaaaaaaaaaagtgtccctgccttcaagaagctcatcaagagcttatttaaaaagcatacgaaagacaggcaccctctttcccgttctcccccatcctgttcttcccgtccggtcctctgccctcagtcattcgcgggagcgcaaccagcgatcccgccccagtccggctgccaagcctggggcctgtccccctacagggccgatccggaggcggggcccggccgcccgcggaccctccctcccggccttccgccaccggcgcgggcgcaactcaccgggcatcagctcttccggctccctcatgccacgggcagtacgggcagcctgcgccggggccaggaggctgtagaggacggtttggtcggggctaaagcagctactccgcaccgacgcgggccgcgaaagcccccaagttccgcatggcgaaactccggagatcaactacaaccgcgctcccggaagtcaacaaacagccgctacgggcaacgggggcggagcttgggaatgcaaggcgggacaggcgccgttggggaggggaacggaggccgggtggctggtaaggggcaggctcaggcacagcggaggggcagtagagaccacgcgccctctggcggcctggagcagagaggcggccacgccgcgcagtgatgctgtggagtccgcgcccttgtgccgttggaggtccaggcgccgcagggaccctgcccatgagtggcaaacgtcacaaatcccatactccgtgacataagcaagcatcgacacacaattatgacactactagtaatagtgaccagctggaacattaaaggaggtaagcactctgctaaagatatccccagcatctaaaccaacatctggcctatactgaatgctcattacgtatttattggacaaatgagtactattacaaccctgtaaagtggttaatgttacctctgtttaagcatgtgggcagctagtccagctagtccagcctgtagtcaacaaaagtaaaagctgaggtgtatatggtccactactcacagaacatacacaaaggggtagcccaacatcattgctctagaatttgctcagcgatgttatatgatgcagggtttcccatgcatcaacatttggctatcatgaaataaagaagcaaaaagccatcttccagaatgagcagatttacgtacgtttggtagttgtggacatgggccctagaatcagacacaattggattcagggatccctgaattactcttgtgtgttaccaacactttctcaggaagtttgcattaacatgaagaggggacattaaactattagttacacaaataatcatttacttacaaagcaaagtggaggttactaaggaagtggttaacaagaagcgttgacctggtgtaggaggttaagaaaggcttatctgaagaaagaacattaaatctaagaactggagaaagataagccaggagggggagagagctcttggcagagagtaaattgtgtataaaggtttgtaaggagcttgactctttccaggaacaccaagaggcgaggctggttcctagcgaggtggcaaggtcttgggcctattaaggatctgagattttatcctaaagacaatgtgaaaccactgagaagttttaggcagtagaacaacaggacaggatcagttatgtgtgtccctgaaatcattctgcctggtctagatgctttgtagagaataaactggagcagtgagaagggttcagaggctattgcagaatttcagacatgtggtcaggatggcttggagtacagttcattggtgccagagaggagcaggcagatttgaaaatattttaggtcttagaatcaacaggaaatggtttctgactattgactcctagacagtgctggactaccaaatagttcttagagcaacagcaaagatagggccctaaattattttgaaaaggatttgatattcatttttagagtatcataattgttactacgggcaaatgagaatttttaaagatttactttttaatatgcagtcatttgtttttatttcaaaatacagtaaggcacattttggtgctaagcatcccagaagatattgatgcagccctactccaaggtttccaacataagcaaatagcaggaggggggcaccatttactgagatggggaacactgaggaaagagctggcgacattggagttaggtaaatggggcaagaagagcataatgagttcatccttgagcacactaagacatcaaattggaggtgctgagcaggtaattggtgagcagaagccccagaaggaggcacgtatttgaggaatgactgggtctatatagtgaaagcaggcttgagatacttgcaacactggaaagtgactgtagaattgaggcagtagaatagggtcgggaggcaggaaagctaaggccaattcatgctgacttcctagaactaaatcaaaaggaaaccccaactttccatacctaagtaacaaaagaaccagaggctactccctttgcaacccccaccccctttttctgcgtggcagacggaaaattgaaagtatctctgattagttgctttttgcaaccaatcagacatttgcatgggagtgtaactttgtaacttcactttagcctctgattggttgctttccacaaccaatcagatgtttgaatagggtgtaacctttgtaagtacacttcagcctctgattggttgcaaggccactagttcatttacatagtaaccaatgggaaatataccaatggttacttgggaatggcaccaagtaaccagtgggaaacctctagagggtaataaaatcccagaaaattctgtaaaggggctcttgagcccctgtgctagggcctgctcccaccctgtactttagttttcaataatgccatcatctccggcatctgtgagtctattgctttacatggcaaaagggactttgcagttgtgagatgctggattcaggaccttgagatggagaaattattctagattaaccaggtaagcccaattaaatcctatgaaatcttaaaagtgaagagcctttccaggctgtggtcacaaaaagatgtgaagatgcaggagtggtcagagagatacaacagcgctggctgtgaagatgaaggtaagggccatgagcggaggaatgcaagcagcctctgaaagccgggaaaggcaaggaagtggatgctccccaagagtctccagaagggaatgcaactctactgacaccttgattttagtccagtgagacccgtttcacacttcagaactacaatagtgtacgataataaatgggtattgtttaagccaccaccaagttgatggtaatttgtgacaacagcaagagaaaactagcacaccatagttgatctcatcaaatcttcacaggaaccctaaatgaagtactaacttcagtctcatttttgggaagaagaatctgaggttgagatcacataattttgcaaggtcccatatttatcaagtggtagatgcaggattgaaccgtcagttccagagccacatttgtactgcaaattcacatgagctctacagtatgaaagtgtgtggacccttgagggtcccctacaagtccatgcagcaatgcacacacatcttcaaggatgctcttgcctcctccaaagagccccctagcaatctctgcttcatcatcattcaattctgaggctgtgttgtgtttttttgggagccctctccaaatttgcaatgaggccacatgaccccttcatgcatcaaggacgttcacatgcctcatcacagcacttattatacagtgtgatgtgattttgtggctgtctttccactagactgagttctttcatttcctgcattgcaagcactacctctctttggccagaacatagcactatgtctggtacatagcttactaaaatgcaagttctatgagggcagggaggtttgtccattgttgtactccagtgccagactattacctggcccataatagctacacaataaatatctgttgaatggcagaattaatgaatagcaagttctcaaatacgcagaggctgagggtcaataaacctataaaaataataatttaagccaggaggaggtgtcatcctgaccccatgtagaggggctggccttagctaggaggagatacatttctagcataacaggatataaatgttatctatatagtattttttttttgagacagagtttccctctgttgcccaggctggagtgcaggggcatgatctcggctcactgcaacctctgcctcccgggttcaagcaattctcctgcctcagcctcctgagtagctgggattacaggcacccgccactacacccagctaattttttttttgttttttttttgttttttttttttgtttgtttttttagagatggagtttcatgatattggtcaggctggtctagaactcccgacctcaggtgatccgcccacgtcggcctcccaaagtgctgggattataggcgtgagccaccacgcctgtcctatatactattttttttgagacagggtctcactctgtcacccaggctgaagtgcagtggcgcaatctcagctcactgcaacctctgcctcccgggctcaaccagtcctcccatctcagcctcccgaatagctggaaccacaggtacacaccaccacacccagataatttttgtatttttgtagagatggggtttggccacattgcccaggctggtcttgaacttctgagctcaagcaatccgcctacctcagcctcctaaactgctgggattacaggtatgaaccactgtgcctggccatctatactattgatatatatgatccagagctatataatatatatcgcaaccccaggccacgaatttgtactggttcatggcctgttaggaacagggctgcagagcaagtgaaacttcatctgtatatacagtcactccccaccacccaagctccaccccctgtcagatcagtggcagcattagattcttgtaggagtgtgaaccctgttgtgaactgcacatgggagggatctagattgtgtgctctttgtgataatctaatgcctgatgatctgtcattgtttcccatcacccccagatgggaaccctctagttgcaggaaaacaagctcagggctcccactgattctacactatgttgtatatttgtatataacataatgtataccaacataaatttgtatatttagttatatattacaatgtaataataatagaaataaagtgcacaatgaatgtaatgtgcttgaatcatcccaaaaacatccccacccttcccctcaccccccatcccctgtcagtggaaaacttgtcttccacaaaactggtctctggtgtcaaaaaggttgtggaccactgatatatatgatgtgtatatatagctatgctgtagccctagattttatatatatatatatatatatatatatatcatataacataatactatagtctattccagaaggtggttgtgaaatattaggtaatgcatgcaaaacttatagcttggtgcctggaatagtggagcactcaacagtgttagctattaataaggcaaaggcagctcactgtattagtcagcataacccatgctatgctgcagctcaaacaacacccaaatctcagtggcttaacacaaagaagtttctttctcactaatgctacatttccagtgtgggtcagtcagttggaggatctgctctacctgctcaagcaggggcttaggctacatatggaagttcaactaccttgtagcaacatcatatacaacacatgacctctttggttgctgtagcagggcaagagagagaggaagttagaaatgaaatgtttcaggctgggcgcagtggcttatgccgtaatcccagaactttgggaggctgaggcgggtggatagaggtcaggagttcaagaccagcctgggcaacatggtgaaaccctgtctctactaaaaatacaaaaaattagccaggcgtggtggtgggtgcctgtaatcccagctgcttgggaggctgaggcaggagaatcacttgaactcgggaggcggaggttggagtgagccgagatcgcaccactgcactccagcctgggcaacaaggagaaaactctgtctcaaaaaaaaaaaaaaaaaaagatataaacggaaatgtttcaggccacaagtaacatgtttttccttctcacaacccattggctggatttagtgtcatgtgcctctgtgcactgcagagaggctgggaaatgtgggagagccagtggacattcagtgagtagtaaacagctctgccacaatccctgcagtcagatggtttaagcctgtggagccacctccctcatgttggagaaggcaggtataattttatatctctcaacagtcacgcatgctttcggtgtcgccttcatacacagccaaatattcctctgctccttaggaaatcatgttgatacacagaagccatgacacgtctgacaacgtgcacaagtcttagcagttgcctctattaattcaagttgttattcatttctggagcattgtatgtcaactagaaatagaggcatgtatgaacaaggaagacgtttgatggattatgcttcctagctgtatttgtttctttctcgacagcattcaacaaaacgtccaaggcttgcaattttaagtagcattacaatgcagctgccatcgctgtttgtttctctatatggaatcagataaacaggtgtgtctctacaaactccgctgggaaatcccataagcatatacatttacaaaacagattctaattacttctttgatttctaaacttttttagtgcagttctaggatatatgatttgaggactcataggtccaaagccagggagttttattcatgaacaagaaacagaaggcaggtacagtctactgcacattttattacgccagagaagaaattttgcactttccttcctcagggtagagtttcaaaagaagaattttgaggtgtctgtgacagcagttgtatgaataggtaatgtcctgaatgactactttgaaggatcatgtactatgatgataatggcttaggttaatatctcttattactgctagatattgttctaagcactctatgtattaactctttaaattcccgtattacagaagagaaaaagttaagttgcccatggtctctcagcgaaaacatggtgggggctgggatttgaacacaggaagcctggttccagaatctatgttcctagtaactacactctactgcttcttgaaagagcacagaacagcagtcttcagactttttagcttacacatcttcatttataatcaaccaaaagccagaagacatgagagctcattaatgtagcccatgcaagtcagctttcctgggtagatatctagcactagaggcgatcagctggtgcacagactcaagtcagaagattgaggaatgaggctgagaaaaaaagccagagatcaaggaagattactcagcagaagcaatacatgtgtatttatatatttgtatgcatgtgctactgtactactatattgtgtatattgtaaagcatacacaaaaaacaaaagattttaaagggtgagataaacataattaaaagttatattatttgttttgttccaccaagatggattgtcttgagcattccctagggcaggggtccccaacccctggggctgcagacctctaccggtctggtccatggtctcttagaaaccgggccacacggcaggaggtgagcagcggtagagcattaccgcctgagcttcacctcctgtcagatgaatgaaggcattagactctcataggagcacaaaccccatagtgaactgtgcatgtgagggatctgggttgcccgttcgttatgagactctaactaatgcttgatgatctgaggtggaacagcttcatcccaaaaccagccccatcctcccaacattccccaccctctggtccatggaaaaattgtattccaggaaactgatccctggtgccaaaaaggctgggggccactgccctaggggacatgcaccccagtttagagaataggcttgggatagcacagttttgactacaggctttatcacttactactttagtaatctgggcaagctgcttactctctgtctctgattcttcttctggtaaatcaggataacacctcctaatttgcaggattgttgtgtggtttaaatgatatgatgtgtacaaaacctgcagtgtctggttttcagcaagctctttacttattacttattttctcccagagttttaattcctattatttgtgtttcatgggctgtgtttttaaaatttcattgcttcctacccactcctgtaattaagctgcaggcagccctgcagttagacatggtgcatctagatggagccagattaatagctttttcatgctgcattattgcaaatatggcacagctgtgtctctgacagaaaaaattgaggaggagacatctggaaaaacctatgtgcattttactttgtgcaaagcactataggaattgggagggaggaagaaagggaggactaactgactgtcagacacttaaaaatgaatggcccaactgttcagcaattgtatatctgtgaacagaagctcccttttacatcagctgttagtcactgccctttgtgattgggaatcaggcttgaaaattctgagtgtattttgagccatttttatctatgcctttctgtgggcgactttttcctaacagggtcccttgaaaaaattcagtctcatttactaccattcactaaaaatttcacctttgatcccaactctgagttttttttttccttctttaacccccttttagagtgttaagtctgttgggtttctttggcacaaagttaaccagaaaagaaatgtccttgaaggcatatcaaccaggtttccaactaacagattacaccctcttgttaggataatttgagaaggatttatttataaaagaactaattttgaggggttggaaggagattggggcaaccatgaggcattgtgcagaagatccagggataacagcattagacctgttactattctttggcccaaagagagaaaggaatggagagtttattagaacttggaaggaaagagagttgtgtagagcagtatatcttgagagaaacagtgaatttctattaaggagcaagccaacccaagatgtccttacagaaaggggagaataaaaattctgactttactctactccctccctccattctcctgctgtgatttcattggccaaacccaaccagaagctagaagatatgagagctcattgatgtagccatgcaaatgagctttcaaatcagctttcatacataggtatctagtatttgaggctgtcagctggtgcacacaatcagtgggaaatgaagctcaaaaataaaaaaaataaaaataaaaaaaagagagagatcaagaaaagctacccagcaggagcaatctggctaggacaccactgctggatgcaggtaccgctttcaccatacttttaattttattgtccctttatttttcagtcatagtctccagagcaaagtcctaggtgggagtattcaattggccgaggctagttcacctgcccgcaccctgtttgccaaggggtgggaagaaagaatattgcttgcctttgccctccctggtaggaattgcacttctgctttttttcaagactcacacaattagagatttgtagatattaagaaacagctcagaaacaaggtagttctctctcctctaaaaaaagatcagtctccactaacagtgacctcctaaatctttattaatctgcaacaggaaactagcagacaagagtacagagatctgtgtttttatttccagttctctatcttttctccctcatttccttccttcctccatttcctgatcgttggaaagcccctttatctctccagatctttgtatgagagagcagcattaagatcaccaaatctagttgtaagttcaaatgctgggccgtcaaaaaaacacatacaggcccaccaaatagcatgccttagtcaacattttcctggtagaaacctcttggtttgttgatacctaaccttcattgaagatgcatgtctctcaatacaatgttgtgttttccttggctgctctttatgtaggaaacatttatattgtatttatatccttaaaatgcaatgtaacattttttaacagagtaaaagatgagacacacataagagactcctctgcactgtgtgccttctgatatgcattcacaagggacaacaaatattctcactctctgaaaagtccatctacatttttctccaaatttccttgcctccagtctctaatcttgttccttccatgtccctaaatatctggccaaaccattaacccctgatcatgatttggtataggtctatgcctctggtcttctctccctccacgtaaaatgcagtgagaggcactgcttgaaggtttgctcactgggagcgtttgccgtattcaccgcttggattcggtatagatgctcgacctacagtgaatcttgaattgttggatccagaccaatctataattacatttctcaaccttcatcaatcatccttacactctattcccatacacaattccctgaattttttccattataaactagaaatctggaagctctttggccttgtctggcttttgactttgttattgctaccgtcctccaagggccatgctgaaatctgacaatcttgggaaatgatagagaagacaggaggatgatgagaactggctttctcttgcaagtaactccctcaggttaaaaaaaaaagcatcttcaatcaagggaagaacagtttcatcagacaaagcaagagagatttctgaagctggcaaaagagatttaatgagaattaagggtttggcattcatggggtcttctaaatcctctcatgtatttccatgtcaattttccagctttcaatctaactcagataatgccacaatatccacctaagaaacctgtcagggctgtgagtactactgacattgtaattgatcagcatgcaggatcaaaccaaagtctgaatttatctttgaccatctcagatctgctgaggcaaatgacttttttcaccattaagctatttgttataagaaatagccacctcatcagctgtcattgaactcctcatgccctttatactattcttgaatcatactctcaatgggcattccaggtgaccataggcaactgtttaagttgttttgcagctgtgtttctaaagttcagtttactgtcagtcaaccagtcctgatttttaattttccctgagagtcagttgcctgtggcttgttttgtgacaccggtttctgaatccgtcagagttcttgagaaataaaaaggatttagtgggatcactttaagttgaccaaattgtttcttctaaataaataatacatccacactttgcccccttcctttttttgtttgttttttgcaaacaagatcaaccatgtttatttttaaacaagagaaattataaaccaggatattctttgaaaaattaggtagaaggcaaaaaaccatcagggaatgcatagaatttacggaaagtctagagagaaatacttgggcaaaggtgagaaactagggaagagaggcagcaggaaattgggttaggatgttgctgctgactttgctgaagtccacaaccactgctggacctaaacaccatggcaaggccttgctagccacgggacacagtcagcattattggttggtaaatctcatctcactgcctcttttactttagtccttcaagatccaaagccccaggtggggagcattccagactggatcatgtgcccatgacctggcttagcagcgggtggagaaagggagtaatactttacactaagactcacacaaggggaactagttggggggtgggttcggatgccaggcaatgaaaacttattttgtctgaatcagtagtagaaagtgctttcattaggagtccagaagttgttttctatttctcacttcaacacttgctttctttctgtttctcccacctttacctaatcttaaggaaatcactgtacctttctggtcctctggaggagagagttaaactaagatattcagggcccatctgtatctaatccatctatgtctaatgctctgtcatcttagacctctcacaaatctagtaaggaaggtactatgcttacatgaggagtttaataaatgcatacatagtccaagatcgttccctttatctaagtggtagctttttttaaatgcttattttaggttcagaggtacatgttcaggtttgttatatgggtaaactcctgtcacaggggttcgttgtacaaattatttcaccacctaggtactaagcctagtacccaatagtttttttttttttttttgctcctctccctcctcctactaatgggtagttttaaatgatcattttgacccagtttcttattgaatatgaaacttttacatatgttagattctacatatttatggaattcccctataatagttgatattaaagcatttttaccttacttaccctttaacgttttatgtttattttaatggacccctcagtaaccactccaccccagtccacaaaagttaaaatgcatataaaaatcaaggtgaaccttagggagaatggtgataaaggaagttgatattctaggagaccttagggtcttatcaaggttgatgcatcagttttactttacatttcttatctatctaattatttcaccagtttgattaaatgaagctaaaattggtattgatgaaaagagaaagcacaatcaaaaaagcagataagcaaataattgaacgcaaataacttttaattatactcacttaataaagttaaggaatagtgtcaggtgccaacatcactttgtcaaatcaaagggcagtgttgggatgaaaaagaagaaaatagtacagaatgtgttgaaaattgtggtaaatttcaaaattgtgaaacactattgtatgaatttggttgaaaataaccctgaatcctaggtcgagaatatgttcagaccctccaatgaaaaccccactttttgcatccctccacacatcttattacttgtagaattctactaaagtccccaagcttccccagacccagagaaataagtgggtttccaggaatggcagttacatctggcaggtttaaaatgcttttccacttgaaattataatgggaatattagcaaatagctttaactttaagttgatcaaatagtttcttctaaactaaagaatacagtcacagtttgctcccttcattgtttttttgtttttttttttttgtttttttttttttttgcaaacaagatcaagcatgtttctttttaaacaagagaaattataaaccaggatattctttttaaaattaggtagaaggcaaaaatgcttatttcctaccccccatagtatttaattttttggtagaataataacatatgtaaaacattatgaaacaaataagaagaatcaaagttataatatgcagataatatggttctttaaagtaaaagtaaggcctcctttgtgccctcttaatgaacgttccattataaatctaaccactcttgtatcctcttatcaccatagattggttttgtcagtttctgattttttttttcttttttgagacagtgtcttgctctgtcacccaagctagagtacagtggcacgatctcgactcactgcatcctctgcctcccgggttcaagcaattttcctgcctcagccttctgagtagctgggattacaggcgcctgctaccatgccccactaattttttgtatttttagtagagacagggttttaccatgttggccaggcaggttttgaactcctgacctcaagtgatccgcctgcctcggcctcccaaagtgctagaactacaggtgtgaaccactgcgcccagccagtttctgaattttctgtaaatgaaaaacacacttttttatatccagttttttcactcaatgttatgtctgtgaaattgttcatattgttttgctcccttcctaacccaaaattatctggattatttattctctctgtctagtttcctattgccatgatgcacataagaaaaaatacctcgtagtaatataaactaaccaatacatacagaagatgatatgtgaacaacatatacattggataaaaagaatatgggggtggggaggtttcagtgacattattagacactgaagatgatgtgttattttcatatggattttgaaaaatgtatcactgatgtctctagagtcattctgtgttcaagtgattgggggaacctactttagaaaatgactgagttgtttccatgtcccctgttgctttgaataaacagactgtaattgtaaattttaactggcaaaaagagtagtggccatggtagcgaagggattttatgatccatttttattatgcatcttcattacaccggaaggcaataatcactcttggcatttagagtcttttgtatttttgaagtacttaacagtcatttattgttttatcttattttcatcttaaatgggataggttggttagcataacagggtcacagaaggacaataaaagattagaaacttgtaacgttagacagttgtactgagggagaacaaagttcctggctttcacattatttaggcaaaaagagaaaagaagaaagaagaaaacacatcataggtcttcagtaagaagcactgtttcctttttattttccactagtttagacgacaagagtgtgatttctttgtttgttgttttttgtctttttttattctttattttattttatttaaatttattattttcttaaatttcacttttttttttttttttttttttaatggagatggtgtctcgctctgtcgcccaggctagagagcagtggcactatctcggctcactgcaacctccgcctcccgggttcaagcaattctcctgcctcagcctctcgatgcatagctgggattacaggtgtccgccaccatgcctggctaatttttgtatttttagtagagccggggtttcaccacgttggtcaggctagtctcgaactcctgacctcgtgatccgcccgcctcaaagtgctgggattacaggcgtgagccaccatgcccagcctgaatttcacttttaatacagctctggagtggggtgggggtatgaaagaaagacggacacctcaacacttttatttgtaggaaagtgattagaataagccaagaactgagccagggatggggcctctcaccacatgtgccaatggtagtagttaacaaaagctaacatttattgaacactgagctaggtactgtgctacagtactctctattcattattacatttcatactcacaacaaagctatgagtaggagctgctagtactgcttgccagatgattcgcttacttcttaatggtaatacattgcataacaatgaaggtgacctggaaatccatgaactccttggttccctggaagaaatggtgaactccagttgaaaaattctggaggaataaatcaataatggtgaatatgtagcacctatgacctaggctccaaacactcaacaaagccccatgaaaagggcttgtttctcttgaatcttgaagacaggattcccatggtctatcttccagaccctaaataggtcccatctttacaggccacagagttgttaccagtggagcagccttgagagaagaaggctgtgtttaatcattagcttaaggtgagggcagagcccctgcttagtagatatagcccaataaagcaatcaatagcaggtcaagagcacctcccaagtagggtctgaagagaggcaccaactacaaagatggtttcaagtttcaccaaaaagtagaaatgggcagagaaggcattcaccaagcagtgacttttgaagccatccaagacatgtttcctgggctcaaggggagaatattgccatgaaaattattactgggacagtgctcctagaccaaaccctggtcagtagaaagcaatgaaaatgatctcatgggatccccatcactcaggtcctgggagtgtctggtagtcacagggagcattagggctgattgttgagacactggtgaactttgaacctctgtgatttccctgtttgctctgtgcctgatagctttcagtctgctaacaaatctcctttatgcagtttaacctctgtacttccaatggggaggaattggaatcagcctatgggagaagagatagctctaggattctgtgtgggaacttgaagagataaaagggcatccttgaaagagaacctcgtgctttgcatctcaactgcctctgacacaaggttgggtcattaaccatatttatttacccctttcttacttcataaattgtgttgtgcatttcctaatcttgtcttctgtgcagaaatttaccagatcacaaaataaaaagaaccaggtatggaaacttgagacttttgtccatatctaagctcaaaaaattctggattctgcttaaaatcaataacttccagggcaaatgattaacagaataatgatttcaatggaaatgtggtctatatgacaagagagaagcgagattatacttgaatttgatgattggcatttcacactctgttcagaattttagcctttatgaaggaccctgtctaccttcttcaaatgcctcaattgaaagggtatggcaggaaaagggatggagagggggtcagagataatcctcactgatttcacaatttcccctagggcccacctgtttgaataaatacctagtggtgatgtagcaagaaaacacccctgaatcaatatttttagacaaactaccattaccattaccatctgttaattagaaagtaactctcagatcgcttgaacccaggaggcagaggttgccatgagccgaggttgtgccactgcattccagcctgggtgacagagcgagactctgtctcaaacaaacaaacaaacaaaaaacataaaaaataaaaaataaagtaattctcagattctctgtaaatcaggagctcttttggtgatatatatatatacacacacacacacacacacacacacacacacacacacgtggagagaaaaaaaggagccagctaatgggtgatttcctttactataataattctaatttatttcttattgccagtttccacacaggtccaagccgcaaaacaataccgtctcacaacagagcagagctttacagcttataaaacattctgggaatattagaatattaacacatgaagatttttgggtccttcagcacgttagatatgacctgggacatagaggactcttaagaaaagagaaattgggcatccacatgtggaaaaaaaaactcaatctcaacctcaagccttagacaaaactcacagtggatcacagatctgaatggaaaatgtaaggctacaacactttcagaagacatagggagagaatctttgttaccctgggttatgcaaagagttcaacagcatgatccagagaaaggaaacaaatggtaaattgaacttgatcaaaatttaaaaattttgctttgtgaaaaacatagtcaggagactgaaaagacaagcaacagactgggaaaacacatttgcaagttacatatccaataaaagtgttgtatccagaatatatatgtagaacattcaaaactaaacattaagaaaataaacaattcaagtaaaaaaaaaaaaagaagaagaataggggtcaggcaagctcagtggctcacgcttgtaatcccagtgctttgggagtctaaggctggaggactgttcaagaccaggaatgtgagacaagcctgggcaacatagtgagactctatacctaccaaaaaatttagtttggtgtggtggcacacacctatactcctagctatttgggaggctgaggttggaggatcgcttgagcccaggaggtcaaggttacagtgatctatgatcacactattgtgaaaccgcctttgcaaaattatgacagacagtgaaagaaatctaacttaaccgaatccatcttgcttctaaccttcaagctgtccttgttcattgctgggcataggctgaactaattttgggagaaacttagtttatagtttatggtttaaacaaagacggtaacacccctttcccaaagtgacctccttcctgcctggggactagacttcctttgtaggactaacattagccacaagatcagatgagccagtttattgatctggtggtgccagctgatccatcaagtgcagtactgataccccaagcactgattttaggagcagtttagggagggtcagaattttgtagcctccagctgcataactcctaaaccatattttttttttttttgaggcgaagtctttttctgtcactcaggctggagtgcagtggtgagaactcagctcactgcaacctccgcctcctgggttccagtgattctcctgcctcagcctcccgagtagctgggattacaggtatgtgccacaacacctggctaatttttgtatccttagtagagacagagtttcaccatgttggccaggctggtctcgaactcctgaccttaagtgatcttcccaccttggcctcccaaagtgctgggattacaggcatgagccaccgtgcccgaccctaaaccgtaatttctactacaaaggcaatctagtccccaagcaggaaggaggtctgctttgggaaagggccattatcgtctttgtttaaaccataaactgtgaactaagtttctcccaaagttagttcagcctctgcccaggaatgaacaaagacagcttggaggttagaagcaagatggactcggttaagttagatctctttcactgtctcagtcataattttgcaaaggtggtttcaattgcattctagcatgggtgacatagtaagactctatcttcaaaagaaaaaaaaggtaggtaaaatatttaacagatattttaccaagaaagataaatggacggcaaataaggacacaaaaagatgctcagcatcattagcctttagggaaatgcaaattaaaaccacaatttgtactacataactgttggggtgacaatgaaaaatatttgcaataccaaatgctggaaaggttgtggaacaaacggacctctcatgcattactgctgagattgcaaaatggtatattaactctgcaaaaccgcgtgacagtttcttcaacagttaaacataacatataactaccagatatacagctattctactcctagatagttaccctagataaataaaacttatgttgacacaaaaacctatatgcaaatgtttgtagtagctctatttacaaactcctcaagcgggaaacaactcaattgtcctttaatgggggaatggataaataaactgtgatataacgatacaatggaatactactcaacaataaaatggaacatattagtgatacacacaacatgggtaaatctcaaagacattatgctaaggagcaagtccaaaaatactacacagtgtatggttccaattatgtcacattctggaagaggcaaaactataagggagagaggagaagatcaatataccagggattagaaaagaagaggatgtgattacaaaggaatttaaaagggagttttctggagtgatacaaccattgcgtattctgattgtggtggtggttatacaaatctacacatgtgttacaactcatagcactgtaggctaaaaaatgttaagtttattacatactgatgtaagcattttttaaataataaaacatatcaagtacattcatttaacaaaagaaaaattgtaagagagtattgatttccatttgcagataaggaaactgacttccccaaggttattcaaccaataaataggttctgaactagaatccacttctagaatattatttttttcctgttgttatataagaaacaaaccttcaaacacctaagccaaattgtgtattagttagcatgcatttgattgcaagtaatgaaaaccccaatccagagggattgttcttctatgaggacatttgctatttcacataatgaagtggcaagtggtagggagactcatgaggctggttgattttgcaactcagtgatgtcctaaatgactaagattccttccttcttccactcagccaaccacagcttccttataaggctacttcctctcattgtcacagggtggctactggtctcagacaaagatacaagcttctttgtccatatccagtggaaaatagctcaccagcaacagtcccacagaactcggaagacttaactagtgtgtactgcatgcaaatgctgcggcttcttaggatcttaaagattctaggcaaccagctataaaaattatttatgtaactagtaacactctgaaacaaatcagagcttcgcactgcagtaatcgccatctgtcttgtttgtatggatctcaaatttgcagtatttttttgataatagctatctatgcccgggctcttagacactatacctcatgtttgattagcatgttaaaatttccacagcaccataataactcattttatttagttggacaggtgaggactctgagggtaccgaatgacttagccaaattcaccaggagtgagtgactgagccagaggtcacatttgatcttcaaacatcattctcatcattctttcctttatatcacattgattccctcttcaatgcttggatttcactagggaagcacactggcaatttcaaagaaatatttcaagtttatacagatacttaaaagctcaaaatgtcagagaactaacattctttatatccccaatagcaacatttggctatttggaattttattctcagtaataggataaatgtgaaatcctagcatctcattaacttcttcgtctcccttctttcaacatccaatcaattttcatgataggcgaattctaatttctaaatcgctcttgcatccatctcctgttttctatttccacagccctaatatgtattcaggcctcatatttgtcacacaataacctctttgtctctttgcctctattttcttcacattgtacttctcacacaatggccccaggttaatggtttcaaaacccaatgcaaataatgacatatgtcttcttgtctgccccagctccaaaactttaataatcttcctttgactaccgattaaattctcaactctataatctggctttcaaggccctcagcaatctggcttcaatatttctttccaaaccttgagaaaatcctcctttctgggtgggagtagtagacagtggtatactggagccagctcacagtagcttgcaggaactttttttttctttttttttttttgagatggagtcttgctcagtcgctcaggatggagtgcagtggcgcaatctcggctcactgcaagctccgcctcctgggttcacgccattctcctgcctcagcctcccaagtagctgggactacaggcacccgccaccacacccagctaatttttttgtatttttagtagagatggggtttcaccatgttagccaggatggtctcgatctcctaagaactatttttatacctctcttcatctctgtgttcagtgatgtcacattagtagcttgaaattggctgtgatgggaatatttacaccttacaagtcagactgctacaattcagagcttttgttttgaagagctagttattaaacatttaccagcataccactatttacagaataactgggactaaacttgagagtgagggtgcaatatggtattggggaccaagttgttgacacagaaagctcaggtaccaactcaaagataggagggccagggggaaaagaagaagaagctgtgttgcaaaactgttgagaaggtagatctgggcaaaagttgagtttccatagaagcagacatcgagaaaggggtttgggttcaagtagttgatttgggaggtagtcccaggaagcactggcagggtagtgagggaaatgagacagggaagggaaggtggctaatacagggtagattgatgagcaggttattactgtgggcaattgaggttcaattccactggggaccttttggggagcatgtagaatgtgcttcatagttgccactgctatggtttgaatgtcaactgaaaagcttatgttgaaatttaagtggcattgtgatggtagtaagaggtgggactgttaagagatgtttagaacatgaaggctctgtcctcatgaatagattaatgtggttatcacaggagtgggtttgttatcaagagaataggttgttataaaagcaagttcaatcctctctgtctctcactctcaccctctcttgccctttaccttctgccatggaatggcaatgcacaaaggtcctctgcagatgccggaaccattctgttggacttcccagctccagaactgtaagccaaatcaacttttctttataaattacccagtctgtggtattctgttacagcaacacaaaatggacaaagccacccacacaaagagtgaggaatatgagaagtttatcctcaagaagacagcagtgggtatttgcattaagaagtggcaggtatgtaggggaagaccgaatgccaaggggatataaacaagacacagatactcgtagttttttgttttcatagcgtgcttggtggtggtggggcttcatttcaatggccaatgatggaatgtatttttccagttatatatcatttgtttttaccctacacactctatttgttccttcctttaggtctactcacaggttcctttttttgctacaatatcctttgtagctccctccagttttgactattttctgattcttgcaattcatcaaaaatcagtgccacctttttcaggaaccccatctaatccccaccccctgatgatagaagttaggagagggtcacgtcaagctggaggtctcctgtggcttgaagcaagggagcaggtaacaagcccctccacctggttaagatgtttggggtcagagagcagagacagaaattgtattctggagtcattccaaatggtgaatattggaaggaactcatcattcctgttttatcactctgtctctcagaacccacacagcacagaggattggcttatgatggctgcacaattgttgatggtggcagagaaaaatggatgaatgaaaggctaggtgaacaaagagaactagataggtagtgaaacaagaaagttaaaattgaattagaggaatcatggggtcaacaagagcccctggatgaattctgaggatgaacatcaaagcctgtaaagtaaaacagactccacatgtgacataatcagcagaagctgggtagttgaaatctacccctcaacaagttcattgagatgccctgccttttgagattcagtgaaattgcttttaacttcatcccacttgtgatgcagctccccttttccaatccctctgggagttattggtatcttaacttttttttagttccctctggctttgagctcctgcatctgtagcattaggagggtttgtgagttgctttggcatctcagaaatgctgcctgtactctctagcatggaactgcagacacttcttgatttctccccaagcattaccaatatgagttgtgtgtatggctagcacagttcagtgaagatatggggtcaagctatgggctttatattagcctgtggtttggcctcatctccctcaggctccatgcaaacgttcaatttcactcctgtattatgtggagcgcttttgctctctgaaacctattcaataactggccttgtttgcctcttcaaagatgctttattatgttttttaaattcactctctcccttctcacctctgtacctttgcaagcagttgcttctgcctggaatatcctttccagaatggaagatttggtagaggttgggaaatgtcagtctttcccctcactttatctcacatcattctctgtaagtagaaggaaatggtgacaatatttatttctctactagtattaattatgacatcacaaacatctcggctcctgaggtggccatagttggtctttaaataacactttttggtattccacaaacttctggaaaatatttacttgggtttgctaaagtcatataaattgaccagaagaggcagccctacccctgcccctcctctccttcctcctacccttcctaccttagagggctcccgcttcttcgaagccagacaactttgtctggacctctcctatgggcttgtattatggatatttgtttataaatcataccacctttactgaactgtgaactctgcaaagatgatgtcatcttccctctctgaaacttcagtgcagctcggtatctgatacagaattgactttgaatcacctgatttctaactgaggataaatgaataaatgtgaagttgcagatggccccttagtgatctgaataggctgctaggggaagagcatatggtatccccacttcccacttgtactgactgtcaggtgctgttagaatcaataggcaactatttcttttctttttctttctttctttcttttttttgagacagtgtctctctctgtcacccaggctggagtacagtggtgcaatctgggctcactgcaacctctgtctcccgggttcaagcgactctcatgcctcagcctcccaaatagctgggattacaggtgtgcaccaccacgtctagctaatttttgtatttttagtggagacggggattcaccatgttggccaggctggtctcgaactcctgggctcaagtgatccgcccgcctcagcctcccaaagtgctgggattacaggcgtgagccaccgtgcccggccagcaattatttctttattgaagacttatgtgcaaggcacaaagggagctccaggactgagatatttttactataccttctctatcatcttgcacccccaaaatagcttccagggcacttctttctatttgtttttgtggaaagactggcaattagaggtagaaaagtgaaataaatggaaatagtactactcaggactgtcacatctacatctgtgtttttgcagtgccaatttgcattttctgagtgagttacttctactcaccttcacagcagccggtaccgcagtgccttgcatatattatatcctcaatgagtacttgtcaattgattttgtacatgcgtgtgacagtataaatatattatgaaaaatgaggaggccaggcaataaaagagtcaggatttcttccaaaaaaaatacacagcggtggagcttggcataaagttcaaatgctcctacaccctgccctgcagtatctctaaccaggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtaagtgatggtcagagacttgggtttgatttaggaatcatggtgatgcataaaactatattctgcagtaaggcctctttctgcagaatgtagtgccacgctctgctttactcttatttgagacagctgcctctaattccagcaaagctttcatttctcagtccttctgtaatcagatttcaccgtgtgctgtaggggaagccacccatggcaggtataacagactaaacgttcttgacatctttcgtttgtgtacattctaaacgagcaagtggctgaaggaaattaggggaagtaatttacacagggccttcagcttatatttgggcttgctataaaacaatatatcactctaagatgttgagactaatcagttcttttgaaaaaacagactccaagtagcaactaataaatactgacaaagctgctgcaaagacgccttatatgtgatggggataacgacatttttaaataaaatacaagtttgaaaaccatccctgaaattcttgctggcatgtgcaaagcaggctgtctccaatgaattcattataaaagtttacatcctgcttacaaccattgtgcatgtggttgaagatggcatggagtgtgtctgtggggaagggaaaggggaaggggaagggaacaggggagatgagttagctgggtaaacaaggccatcaggtggagacatcactaccagaaagcttctagaacagtttcatgttaataatgagacagaatttcttcagagcctctttataacctaaagcaaccttcccgacttccttaaggaagaagcttttggtctgaagttttcttttattattagtaagtggacctgtgatagtggccctgggcatcccttctctggagcagctgacagttctaggttctctggactccaccattagcactacttctttagtgaatataaggctctcagaagtcagaatgataccgtaaataatattgtaaattaagcccataatattagacctagttgagacctcagagccatgaaataatgccttctcttattttattttgggaggaaatgtgatttttatttcttaaacagctcaaatattcaattgaaattgtttcacttctcttatttcaagtataaggtaaaaaaagcccagaatgactgtggggtttaccaattagtgccagagttagatcagataacaacctggagaaaagtttaaagaactaggttcaaggcctagcaccacccttgctggctatatgaccttgaacaagtcactaaacttttctgcaatgttgtttcacctataaaatggaaaaaaggataatacctgttctgcctacattacagggtggttcaatcattccttcaacaaatattaattgaacatctactttgtgccatgccctatcaaggagttggagatacggtggtaaataacgtaaaaatatacttcactccagctacatgaattcatagtctagtgataatcagtgagataatgtatatgaaacctaaaaagtgacagaccaatgttcattatttattttagtattccattacactgagttacatcagataaaaatgtgatgaaattttattctatagcttttaacaaggaatcatcactgagttgaaaacacccaactgaatgaataatcaaagcctggaacttaaacttatactgttctttgaaaactacaatgataattgatttttaaaataattattacggattaaattttgcaagtaaaacctcctccaaacagttgaactttttttttttgtatttactaatacactactgtctatatccagtagccagactacatttctgaaaatcctggtgagctatttctcacagtgaatgggggctggcacaaaagtatggctaaatcggcccaaatccaaactttctatttgaaagtgtgaaagcctcgagtcacccatgttgttagaaactcaatagtgtgaatctctattgaaaaatgagataatgttgaaatggtttcgacatgcattctcacgtggcataggtatttttctttcctactgtattggttagttgcactacctgtcagctagataaattcagaatttctggtctccaataagacttacaacctttgacaaagccctcaacaacagagaaaaactccctgtcaactctgcctgttctatatttttgctttgattttcagcctttcacagggattcgagttatttttttctcccacatctcttgggaaaggtggagggcccttgttatgtaacataccacgtgagtttactactccagaataataggaaatatgtggttagaatttgatggtgccacaaaataggaatcgcagttttgaagtgagcggtcatatcgccatggacatgataaaataatagcttaagtgaggctgaagccatccacacagcccctggatcaatcacttttagtcagttaaatttttttttaacaagatcgataggatcagaaaccaagactgctgaaaacacccaattcacaggctttccatgtcataaacaaggctctaaagccttgctgtgtttggataatagagaatatcctatgatttgttgcctattagggaaaccacttaaagctttttaagaaaccactaaaaaaaaaatctctttctttatcagaaaagaccaatttgtaagtgcagttcaatttcatctcacaaatagaaatttcttcagagaatattgagctaagctactcaattctgtggaggttatggattggagccagaggtgactagttttcaggtgtttcattccagacctctgtaagggctcacataactcattatgctcccttcgtctctcacacatgcccatccatacacacgtggacatccagacaacgtgattataagacgttcatgttcttgcatagaggagagaaaccagtgcactttgattattcacaatgtcgaaacttaaaatgaatgccttttaaaaacatcacttcagctgggtgcagtggctcatgcttgtaatccctgcactttgggaggccgaggtgggtggatcacctgaggtcaggagttccagaccagtttggccagcatggcaaaaccctgtccctgttaaaaatacaaaaaaagaaaaagaattagctgggcctggtggcatgcacctgtagtcccagctactcaggaggctgaggcagaagaattgcttgaacctgggaggcggaggttgcagtgagccgagatcgcgccaatgcactccagccacctgggtgacagagcgagactctgtctcaaaaaaaaaaaaaaaaaaaaaaaaatcacttcacttcagaaaaccatacaagagatgggaccaaaagttgaatggggtcatgatgttttccttggccaacagtggaatttgtttcctagtttatttttagtaattgagtaacgtaacttagataaaataagccactgatttttgagtttcaggtttccagatctttaatagtaggtctgcagaaagctagccttcatctgaattcttcaattttcagatgagaagtttcacaattttagaatattaatgatctaaggtatcttagaaactactagtcactcagtgctcaataataatgttgtagaaaaaactgagttcttttcacatgaccaggaaagtttaggctcacagacactttgaagggtgagggggagcggaatttattgagtgaaaaggaaaaaaactcagcaaagccagaggggttcctgttaacaggcccccatctcacagactgaatgccaggttaccacacaggaacaggagaggcctagctcctccccactccaaaaggtgcagtgcgaacttccccaaggccccaccctgtcctcccagtgtgcaggtgggcattattcagaaagaatcagtcaggggagtgtggggaaagggcgggcctcatccgggacaggcagtcctgttcatcagcctacaggctgttttaggcttgaacgtggggtttcgctgggggtcgcgggtttgggggcccttggctgccccttgtctctatcaataatttatatcacatatgggtatgtggcaacagtgaggagggtttcaagtaaacttttattaatacattattattgttattgttaataagcataaatttggaaaacatttgtgagtttttttcacatcagtgggatcactgcaaagtttttttttgtgaaaatacagctcctttcttttgcatgcattctaatatgcctttttgagaaggaaagaaagggatagaattaaagttaggccactgaaaattcatgtggctccagtttacaaacttcatgagtgtgggggaagacatagacaaagagaatcgctaatttcgttcactttattaaattttcaggtgaagaattgaggctcgagatggcaaataaccttcccaaggccattgtttattcttaaatctgggctgaactaggactacaattcaaatatttaaaggcactgctcttctcatttcattgcttgtattactttgatcccttccaattgatcaagctggccaatctacctttgcctaatatccttttttaggtacagccagaatatctcagtaaagaaaaaaaacatacacaagaaaatatgccttagctcttgcattaatgcaaggttaaagaaacataaaaatctcagccataaggcccattggccccctcttatgtctccagaagttaaagtctttatctcaaattgtccatggggatcagagtatcatttaacactgaattttttcctactctggcaaaatcagtttctgactgaccacattttactcaaatcaagcactttctcttccaataaaatacaattataccaggaatacatccaagtctctcccaccccccagtttaccagagttggaaaatgcagacactagcaatgaaaggcttcattctgcaagtagcaaatactcttccattttgtagctaggaagatatttgggtaaagttaatacaaggatctcttattaccttggcttagcttcttagcattcagtgatttggggttaagaaatctctgtaattattttttcaaggaataaaatgaatataaggaactagacttgcctttttcaagggctctggctctgaccagactgcagtgacagttttgatggagtatttgtacgtgcttctcattgtttcccacaacattgtatcctccctcttatgtgcagcctgaataataataatgtggtttgtgtctggtgtaccaaggagatttcttgtttactctgatttacttcttgtacactttggtacaagaaaagcaagcattttacaggagactcgaataatgcatttggccctggttctggtgcttgtgaaccagagcaggctgcctcctattgaagaatgaggtctctagggggaacttaatagccattgatgccagcagtcttacctggctaattcaagcgtggctttatcacccaaaagcaagaaaatgcttgctacagaccagaaaaaaaaaaaggaggcctgtgtcagaactgttttaatgtggtacaattgtggaactcttctaatttttatgtagcttaggaaagaggtgtggcaactccattttggagccaaggggaggtctgtgaggagacagtaaacaggataggaatttaaactgggaccattgtatttgctttccttccagtgataaatttccctggttagttctcgatatctatgaaaaacagctctttttcccaagctaacatttcctgccccacctcctggatggaattgagaaaggtggtgactactctaatgatttttcagtggtataaacagcataaccccccctcactagctgtggtggaatttttttttttttttttttgagatgaagtcttgctctgtcacccaggctggagtgcaacggcgcgatctcagctcaccacaacctctgcttccagagttcaagtgattctcctgcctcagcctcccgagtagctgggattacagacgtctgccaccatgcccagctaatttttgcatttttagtagagatgaggtttcaccatgttggtcaggctggtctcaaactcctgacctcaggtgatccagctgcctcagcctcccaaaatgctgggattacaagcatgagccaccgcacccggccagctgtggtgcaattttaaaagaaattctagttaatcactcaagccctcagatgctggtatgaccagatatatagcatctacctctctaccgcttttgtccccaagaaccctgacaacttattctgtccaaaaggagtttgtggcaagaaagaaccaaagtatcagtgtagtccactattactgtacttccatttcagccttcatggtggtatgagcaaacattggccctataaggtatacttgccagttttccaggttttggcccttgactcatagtgctgtgcttaggatccaagattagtccactcttgtttcacatacatatgtccagtcattgttcccagtagtgcaaatactataccagagtggtggggttctaggggatttcagctttagcaacacactaggccacagtcaattatcctccatgattttcaggccttgtgttcagcctgggccataccctatatttgctcttccctcaacataaattttgtcttttttttttttttctgagatggagtttccctcttgttgcccaggctggagtgcaatggcaccatcttggctcactgcaacctctgcctcccaggttcaagtgattctcctgcctcagcctcccgaatagctgggattacaggccctcaccaccatgcccagctaattttttgtatttttagtagagacggggtttcatcatattggtcaggctggtctcgaactcctgacgtcaggtgatctgcccgcctcagcctcccaaagtgctgggattacaggcatgagccaccgcacccggctgaagtgatgttttttaaaaggcattcattttaagttttgacattgtgaataatcaaagtgcactgttttctctcctccgtgcctggcctatgtcttttcttatcatcagaacttggtcaggatgttgaaaatccatcatgacaaatctttcaatattcatcccagaaatctgctgggaattaattctttctttcttttttttttttttgtttttgaggcagagtttcgctcttgtcacccaggctagagtgcaatggtgcgatctcagcttactgcaacctctgcctcccgggtttcagcgattctcctgccccagcctcccaaggagtagctgggattacaggtgcctgccaccacgcccggctaatttttatatttttagtagagacggggtttcaccatgttggccaggctggtctagaactcctgacctcaagtgatccgcccgcctcgtcctcccaaagtgctgggattacaggtgtgagccactatgccgtgcctgaattctttcttatacaaattgatttacttttgccctaatgacctactatcatttattcatttacttaagaaatatttattgaatgactactacattccaagcactgtactaagcaccgggtatatattagtgaataaaataggaaaggtccctgctatttgtggatcatatgtaatccagtgagaagagtaaaagtagcaataaataaacacataaatatatattaaaattgtgataattattacaaacaaaatgaaggtaaagtgaagactacttagacagtagagtcaggaaaggaatctcttaggaagtgatatttaagcttacagcctgagaatgagaaggagccagctttgagagttgaggggagagtgttctggacaaagggaatggtatatccgagtcctgtgatgggaaagcttttggagtacaggcagcccctcctttgcgatatcccaatgtgcacaaatttcaattaccacagtttagttaataacactaggccactacgaacacagttcaaatttcagtcaacatggcatattaattatgagtaattcataaagcaaaacttcattgctaactcttcagtctacaaatcaccatgtaaataacacatacacagtacctcatggtcagtgaccaattacatcacttctttcaaagtctgttggtgattggtcactgtgcatctgtcattcagtttgcatacagacagcaaagagtatatagctgtgctgcctccttttctcccagtgataaacccatgggcattttacaaaaatggataatgacagtgcagtacatgaaagtgcagcagagaaataaaaagtgcctttgggaggctgaggcgggtggatcacctgaggtcaggagttcaagaccagcctggtcaacatggtgaaactccatttctactaaaaaacacaaaaattagccaggcgtggtggcagacgcttgtaatcccagctactcaggaggcttaggcaggagaatcgcttgaacctgggagacagatgttgcagtgagctgagattgcgccgctgcgctccagcctgggcgacagagcgagactccgttaaaaaaaaaaaatactgatagcagtggaagttaaatttggattgaatgtaaatcgagttatggaagaaacagctgactatgtgattgttaccctgctgctgtttgagaggctgtagatatacagccagaggaacttagtgaagacaaagttattgacataactgcagaaagtggttgtgacaaaaaggatgaagatgtcccaggggaagtaacaccagcaaaacacttcacattaaaggaactctcacagatattacacagcgttcaaagtgcaaaggaaaatgttgaaagtttatccaaacttagaaagaattatgacagtttaccaaaacatagaaaagatgcttgctctatatcataggttctaagatgagaaagcaagcactgttcaaattactcttgatagagtttttacaaggaaataaagcactataattctcaatgcttctaatgttttaaattacattgtactaaaaaatacatcagttttactatttttcacttccctacacatttacaactgacaataaaagtttttaatgttctgacaattttttaaaagtcacagaacgattacaattttcccactaaatattaaggttactttacatggcttcagatttaatggctattcacagtcccacacactaccatgcaaattaaaaactgcctgtgtttaaaaaaaaaacagttttggaggacattatgctaagtgacataagccatgaaggacaaatactatatgatttcacttatataagaatcaaaaatagccaaactcatagattctaatttaaaacatcagacaatactggttgtcagaagttgggagtgggggaaaaggggagtttttctatggatctaaactttcgattattctagatgaataaattctagagatctgctgtgcaacatagtgcctatagttaacaatatggtgtcgtgcagttcaaaatttgttaggagactagatctcatgttaagtgatcttactgcaaaaccaaacagcaaacaaaaacacaaaggggcacaaggaaactctggggtgggggaaggttatctgctaacatttattggagatgtgattcaagggcagcaagagtgagggcagcattatcagctgctgccatggaaagtctagagtcagaaagggagatttttccaatcacttgtagtccaagggaaaaatattgaaataaagtttctgttctatatacatttgaaaatcaaaggccttgacaaaaaggaaagcttcaagcaggatgtttgtgtgttctttctacctttatattcaaatcttctgtcagtggagaaatagaaacagcagcatctcacaatgcaaacccacagcagaacattaaccctaaccctaactacaagcttaatttcacttccaacttagaaacttctaagtatgtaggacaaaagctgaggaagccccagaaacttgttactttctccagtctgtcttctattggggataataagaactggaagctggagcttttggagtagtaaaaggtaaggtattgttggtcctcctctttcctgtttccttttatggaaattggggagaaaaaatttagtcctttgcaaaattttcatttccacttctatttctctgagattcaacaagaacaacacaattctaagatctatgacattctcttaaataaagcctgtagccttgtgagcattcagaagtaagaggatacaacaaaatcccgcagaggctgagaataggggatgatattgaatcctttaagtatagcagtttggagactcagcttttgtgggctccaaaataaccaggagtctgagcttgaactcaagacaaaaaattgagggcctcaaaattagttcatgagtggtttttcctgtggttgatggatgtgagttcaacagctatagtgatgtttctcaaattccttgaaacagagggagtggggttttccagcaaagtattcttccccttttaaaataatattagaggaagtcttaagccaaggaatatcaatgtgttattgtaagacatgtagtcaagaaggtttatcttctgtaattttatgttgcttggatcttattccagaagaaaaatattttcaaatctgccccaactgtgaattgagaaagattaagctgccgtgccttcatttcaggccacatatgcaaatctgttttataatccccagaagaagatttcagttgaccctgaaaaatgcatgactgttagtcagtgcttactccttaacattatcagtacttagtattccaagtgttgcttaatattatcactaattaatattatcagaagaaaacacataaccaaaatttgtacgtaaatacaaattttctgtctaaatgccttgcttccaaagttatcaaattgctgactatgatggagatattgggcacagttgtgtaagcattttactaggatttcagtagaaggaagaaaatgaagggctgtctagaaactgctttagccagcaaaatgtctttgtatatctacaaacttatttttaaaatatttggttctttgccgggcgtggtggctcacgtgctgtaattccagcaggttgggaggctgaggtggttggatcacctcaggtcaggagttcaagaccagcctggccaacatggtgaaaccctgtctctaccaaaaatacaaaaattagctgggcgtggtggcacatgcctgtagtcccagctactcgggaggctgaggcaggaaaatgtcctgaaactgggaggcagaggttgcagtgagccgagatcacaccactgcactccagcctgggtgacagagtgaaactccatctgaaaaaataaataaataaataaatataataaaatatttggttcttcttagtctaaaccttttaaatttttattttcgtgtatgttttgttatgtacataatctattagtatagcagcacatataaacaaataaaacatacattatgaatccatgtttaaaagtttttactgttagaggtacgtaataaaaagttgaggaccactgctttaaagaaatttccatttggagagcccatgactcacatatttttaaaagtcaaagacaataatacatctttgaaatagcaatgttaactaaaattttgtttctacatataagctgaaaacagtaatttctatttgtagttgaatatgtcatcaatgtcttagattaaatcagtcaattggctgggtgcagtggctcacacctgtaatcccagcactttgggaggttgaggtgggcagatcacttgtgctcaggagttcgagatcagcatggccaacatgatgaaaccccgtctctactaaaaatacaaaaattagccaggtgtggtggcaggtgcctgtaatcccagctactcaggaggctgaggcacaagaattgcttcaacccaggaggtggaggctgcaatgagccgagatcacgtcactgtactccagcctgggcaacagagcaagactccatctcaaaaaaaaaaaaatcagtcaatcaaccaattagccaaccaactgacaaactcttaatccttatggaaattctcttccctactaactagacctctgaagggctcagtctcacaaaatgtctaccaaaaaatatctattcacccactgaacattaaatgaaccaatcaactctgcaagaaacatatgtagtgcaatattcacttgtctaagttactgacatcatgcagtggaaacaacaaattgagtgaatttgtgcttttcccacctataagcttatcaccattgcaaaaagacctccataaatcccaacagatgattaactcttcatcccaagtagcacaggctctcttgttaggttagaattaaagcatgatcattttgtgacagttattttacttctagtaaaattaatgtttagtacacgtggtgaaccacaatttgcctttggctgtttataatttcgaatggtagaaaataccaattattgttaaacacagataacactaggaatgatgagagaaagatgatgtccattttatagaatgattaccgcaaataacaattattgtcatcacaatataacaaaatgttaaaattgatctttttcggttttggtttctgtccaggcccagtaggtactgattcttccctcattctaaagagatgctagaccactaaaaatggaattgcaaaggaaatagacaaaattcagtttggaatcccttagttaccaccttcagcttataaaatgtgttgcagaaaccaagagaggggttggaaattagaagataatttatagagagtgtttctattgtgtatcatgtgcctcctcccccatgaaggggatactcttccttcacttcaagcccaacaaaatggctccactagggcccacagtaaactgatgtcaggatgatacctgagaaatttaaagtaggaaagacaggctagttagctgttctgatagcagaacaagatggagtctataccaggatggacctgacacttgttagagcaaagaacatggagaacttcccatgaagcaatagggaatgagataaaaaagacctagcatggtattgtttcagatcatgaccaagagacctcctggaggggtgggggaaatctcagcaaaatagaggctggatgtgttcccttggatgccagaggaaatgtaattgtctgtatcaaagactgctatgagaaattcctaatgataagcgggggttctccaaaggacctccaaaaacacatcacaagagagtcaggtgttggagacacgtgcaccaatgctagattgctagagcagaaccaggcttttgctggctcttaactcctcaccttcccttggcttcacttagaggaactgaaagtaaggaaacgaggaaatagcacattggcccctctttccccatagaggaggccagctttaatcaggcataagctggaagggaaaaggtgttaacctgcagcaaatttcttaaggtttttttaaaatcactattattattattatatttttgttacatgttattttactgagactctttgaggtagtaaaataagcagagggctttttgtatttttctgagttagtagaaaagttacagcgtccattgtattttcatccagggataaaaagaacaagctccaagaacagatttgaagggcagtagggggaaaatacgaaattattttctattgtgcattacaaatgctgcttgtacagcccaatgattttaataataatagctaaaagttatcaaatacttattatattccagacaatgtctgctttacatgtattaaataattttatgctcacaacaactctataagattattatagtaattttctaggtgtgaaatttagaagcagagagtgggtaaataaactgccctaggttgtgtgactagtaagtgacaaagccactcatgtggctatttcaagcaaataaaaattcaatctcttttcacaaattctttttttttctgtcaaacatccaaaatactggacatacaaaatataaaccaaggccatatcaaatttcaacgcattaacactttgcagagacacatgaggttatatgtgatttgctgtgctttatcaagaataagaagataaagcatttgctgtgctttatcaagaggccgaggcaggcggatcacttgagctcaggagttcgagaccagcctggtcaccatggagaaaccccgtctctagtaaaaatacaaaaattagccaggcttggtggcatgtgcttgtagtttcagctacttgggtggctgaagcaggagaatcgcttgaacctgggaggcagaggctgcagtgaactgagattgtgccacactccagcctgggccacagagtgagaacctgtctcaaaaaaaaaaaaaagaaaagaaaagaatgccttatcaacagtaaaacaatgaatcaccatagtacatgggtcttttctgaaatacatatttctcccttttaaatctctttttacaggtgtggacaaccactacaaaataaagtgcagctgaagggccgtgaccttctcactctaaaaaactttaccggagaagaaattaaatatatgctatggctatcagcagatctgaaatttaggataaaacagaaaggagaggtatgtaacattttctttttacgttccattactaccagtcccctttttttaaaggcagccttcccaaagaaagagggaaaaaaatacattaaaattcttaaacagtagctaagtaatgaaacctcacagtcaaggtaattgattatcatggagcatacaggcatacaaaaaagcataaaaatcagttattgaatgacaagtcattgcacttttttcacgtggaatgctgaaattcattattaactggatcgaacctaagaaatcatttgtctgaaaagcatttatttatttatttatttatttattgagatggagtcttgctctgttgcccaggctggagtgcattggcgtgatcttggctcactgcaacttctgcctcccaggttcaaggaattctcccgcctcagcctcccaagtagctgggattacaggtgcataccaccacacctggctaatttttgtatttttagtagagatggagttttaccatattggccaggctggtctcaaactcttgacctcaagtgatccgcccaccttggcatcccaaagtgctgggatcacaggagtgagccaccgtgcccggccaagattttatttttataccccttttcttttctctgtgtattttctatcaagtcaaaaatgaaggccaggcgcagtggctcatgcctgtaatcccagcacttagggaggccaggcaggcaaatcacctgaggtcgggagttcgagaccagcccgaccaacatgaagaaaccccgtctctactaaaaataaaaaattagccgggcatggtggcacatgcctgcaattccagctactagggaggctgaggcaggagaattgcttgaacccaggaggcggaggttgcagtgagccaagatcgtgccattgctgtccagcctgggcaataagagtgaaactccatctgcaaaaaaagaagatgatcctttttttccaagtgacaaattttaattttggatgcatatcagatatagaatcattaggataatgtcaaaaaattcacaatgatgtgacagcgttttaaaaagcatttagattagcaaagaaacaattaatggtatccaggtaggagaagagatgggatatggttcttagctataagcataattctgcattttgagcaatttatcttcgaaagacaattaatacagtagcttcatttggactgcttaattgtgaaagcatttttgtattccaagcttgttcagcctttttaaagagttggtttcaggttgagaaagtttgacacggttttgattttatctagtaggctggctctccaagctcctaagaaaaactgaggacaggagtgaccgcaactgctatgggttgatgttcctataaaacacctgaaataagagaaaaggtctccccaggcccaggcctatgttcttgacactttgtggatgagggaggttagctggcaggaatctatttgttccagaattccttctatcaggaagcccatctacagaagaggaaggaggaagcgccccaccccacattcagactctccagattgttttcaaatgacttccagaagcaaagtctttgtattcccatgaggatgcatgatgaatgtgtagctaaaacactagggcttcatcattgatctaagtgaaagttgtagtgccccatgttgtaacagagtagcattttcccagctgagaaaacacctccaaaccaaacaccttcgaggtcattgaaaactgaatggggatttcaatagagttaagtaagaaggtggttccagtatgaaatactaatatattttggaaaaaattcacatgttgaacccagaacaattaatactgctttctaattacatgtcaataagctgtgggagttactgttctcttcccccatttgtatagtacataaaaaaacattttaaattcacttttttttttttgagatggaatattgctctgttgcccaggctggagtgcagtggcaagatcttggctcactgcaacctccatctcccaggttcaagcaattctcctgcctcagcctctctagtagctgggattataggcacccaccaccactccaggctaatttttttttttttttttggtattttgagtagagatggggttttgccatgttggccaggctggtctcgaactcctgacctcaggtgatccacctgccttggcctcccaaagtgctgggattaaggcatgaaccaccacacctggcctaaattcactttttaaacaatattttaaacacttatttgggggtagttattacttattttctaataaagaatatgttttaaaacataatttatatataagatatattttaattctattcttgtccttgatttatagtatttgcctttattgcaagggaagtccttaggcatgatttttgagaaaagaagtactcgaacaagattgtctacagaaacaggtaagtccactgccaaattcacacttgtgttgaagagagggattgaaggtgaagactttggaggggtaacccagtgcggggatttgtctgcctctagcaaccacaaagaaaaaatcatttttactgggagcagcaatgcaagcctgtgaatgagatttccagttctcataaaagctgcaagcagaaaaattagcttcatctataagaattccataaggaactgagtagaagttccatataactcttcatgttcagaaaagaaatataggtgggcacacattttcaggccttgaactcacgtgggtaagaaatatgtctatttttctagcatgcaaagaacatttccttgtgtgtctcaattctgctagatggtggaaatttaatctttgcgatgttaggcaatcctcagttgttttatggtttattttgtccattttgggtctcctctccatttccccacagtcaggttaaatcatggagagtatctgaatgtcaagacatgtaggggtatggggatctggtccttggtcattagaacatcatcatcaaatatccatgctaggttctgttgggacttctatattcccattggatcttggctgtctcccacttactgcaaggtttgcttcactctcattgaaagaactcatattgagacaaccaagtataaaggggtcactggagaacctccaaccggcctgaacattgggaggaatgcacacggggctgaagcctcaggaagttcacaccatttgcgcggggaagagctggcctctcctgttccgaggtggaaactgggattcaatctgagaggcgggaagacaactagcaggactcttgctctgctgagagtccctgttttccttttttttcttttcacccgataaaccctgctcttctcacccttcaaagtgtctgtgagcctaatatttcacggttttgtgacaaggaccccattacaacaatatatctcttggtttcattctctcaacctcttagcagctctccaagacacattaggcacagaggtactacaaggctgcctctactctattgttccttcctcatgctgggtgccatggagctctataacatttactgccttctagaggtctgtcttaaaagcaagacaggttgtcctcagttctgggattctccaaactcatggagctttccagcatgcccccccatccttcagaagttgacttggggaacacatagcagagtacagtatcaaaggtccatcagtttttatttctgttgcttctcctctcttgcttctcttcttcccctttcagttcccagtattggaggccaggaaataaagcaggaggaaaaactggctctgactatccatggactcttccaaattgtgcctggaattctaggctgttaaggatattttttttcctcaagctattatctctgcagtttcaaaatggacactttgaaactcgtaagccacaaattgcctcttttctttctctctgcatttctgctctaccagacctcacttgaatcaataatatgactgcccaaatgagcaatcagacagggtcaaggaggaagtaccgcaaacaaaaacatattggttgatatttcaaatagattattctaccttacgagtgtcagagctttctagggcttagaagcaaacaactattacatgtgatttttaccttgcaatgattaataatgaagcttaccaaatagatatcaaaaagaaagttcagggggattaagcgacttgccaaattcactcaattaatacagatagcaccaagattcagatctgaagcccactattcttactaatgcacactccttccccctaaagagaaggaaggaggacgagggaaatatataaggtgctaatctttaaagccctaggaagaaaacagataagaacattttgctctttaaagctggctgctgtaagagatcatgttgatatctgacagatggtagggaaaaaatgaataaaccagtcagcaattctcaaattctgctccctttcaacactagtattccatgagttgggtagaattttattttatttcattttatcttgtgtgtatatatttttgtttttaccgttagtacttaagagaattgttcttttttgaagtcaccaaaataattgtttaatacatagaaatttctcaaatttaagtttttttaaaagggattttgctgagttcatggcatttctatgacttttccctgttcaaatgttatgtttgaaaccagaatatttctgaataaatgattggtttcaccatttataataatgtggtagttaatctattaataaaaatgagagtgacaatttaataagtttttggaggcagaccctgtgccaggtgttctacattaattatgtgtgttatctcactcaatcctcatggcaactctgtgagagcaagaccattcaggaaaacaggctgaaatggggccagcaaatggctcaaaggcacgtacctaataaatggcagacccaggattggaagctattactatatatatttttaaatacctaatttaataaactaaatctattgatttaatttaattatatggcatgtaatagtcatgttttcttctagtaaaattgtttctactggtggcattaagcattttgttaaatgatggttttctataaagaaatccttagaaacctgccccaaatcgtaaataataacaacaaataaatgaagcaaggagagtatgactgttaaaacttatagttcatggagcatttgtcattatcctcaataattgcatatggcatcctgccaaactcaacagtagaatcactgaaagcgagtagctgtcttaattgtttacagaaacagtaaaccccaatcaaaatcatgacagaacattcctattgtgagtatgtgcatcttaacagttgtcctttggtacaatttttcaacaagtaccacctgttactttggtgcttagaattaaaataggtgtaattataactgttactgccccaaatctgtgccagcccctgacatgatcctcacaggacagtccttggcaattctgttccaagcctgagtttcagagctacgttcacattcctacttatctcaggagacagaatcaaattctccacccaactctgaccatagtaattgtttatgtaacatgtttattaaagtgtaacacacaaacagaaaagtgcacaaatcattaagcgtatagatcgatgaattcttacagtgagcaaaccattgtaactaacacccagatagagaaacagaatggtagtagcacccagaagcttcccactacccttcatttccttccagtcactactcctcattcacccaagggtaactattatcctggcttctaacatcacagattcattttgcctatttttgaactttatattaatgggatcattcagcatgcgctcttttgtgtctgacttcgttcgcttaacattatgagatgtatcgatgtagctgtgtgtagttgtagatcattcatgcctcatccactctttgtgtgtgcctgcctggcaaaccagacaattctcctatgagtctaccaatgataatattcttttatagcaaatgaattgagctgatagacagatacatttattaatctcagtaaatgcagtagctgataaaagatgcaaaaggcattctaagagatggttcttttcattatttaacattggtatttcactttcaaggtgaaatagaaactggtgttttaacggctgtttcaaaatcatcgtctgtacaaagatgccaatgtaaaaattgtgatactattgtgcaattataaaagccaagcacagagaggttaataactgccttagttctaccagcaaaggtactcggatcccttatatttccaaggaatgaattctatttatactctttttaccaaagcaggcagggatctatggggaagtaaaagagcaaaataagatttacttttattttcccaaacagaaattaagaaattagcagaagaggccgggcacggtggctcatgcctgtaatcccagcactttgggagtccgaggcaggtggatcacgaggtcaggatgtcgagaccatcctggctaacacagtgaaaccccatctctactaaaaatacaaaaaattagccagacgtggtggcgggcgcctgtagtcccagccaatcgggaggctgaggcaggagaatggcgtgaacccgggaggcggagcttgcagtgagccgagaacgcgccactgcttccagcctgggctacagagcaagactccatctcaaaaaaaagaaaaaaagataaaaagaagaagaaattaacagaagaaacgctatgttcaaaaatagctgatgtgaaagcataaacaaatgaaacaggtaaaagcaggcttctctggataaagggtggagaaagagtggaagcccatctctctgtcctcttctccttggcaatggcagcttctagtggctgctcaaaacctctgatgcccctcataagcacgtattaccatccagacctggtaaaccggcaaattcttgacttgtgcttttgggctgggatctgaggcttctttttgatctgtgacaaaaattgcaaaggcaatttcttctcagaggtagtatttcctccccatttaatctttttcatgaactgctgaagtctttggctcctgcctgtacacactttctgttactcttcttcctacccctatttcataagtccaagcaccgtatcgatcttctgtatagcacaaacagggaagtagaaggacagcagattaatcctgagttgctatagcaaaatgacttatcatcaaagaaagagtgtgacttggaatagacctaccaggaggtccgaaactttgtttgaagtcttcatccatagtcctcaaccctcaatggtactcatacttgtactaggcacttagtaggtgcacaataaataattttttgacgaatgtgcggtatttatgtgtatttaggtgacgttgcatgtttataaagaaattaagtactcaagagtgattagtgattataatcaccactaaacttcattacgttgcttcatagataatagaaatttctcttctttctgttagcaaaatgagaggctgttcacaaatgagaagaatgggtcctttcttcagagtcaaattcctcctttattcattcaatgagaattcattaagcacttactatttgccaggttttattctaggtgctcgggagtgatacctcagtagacaaaacagatgaaaatccatgccttcatggggcttacattctagtgggtacacagacaataaacaacagacataataaataagtggatgatacagtatgttggaagatgataagtactctcagcaaggagaagaatgtgtctggaactgagggaaaaacaagtgcaccaatattgggactttggctttttggggaatcgttggatgatcttgaacaaaggagggacatgatctacttgcattttaaaaggatccctctgactgagaataaactgtggaatagactgtggggagcccagggtgaaagcaaggtagaagtagtgaagcctgtcaatagatagctatcaattatagaagctggggttgtggtggcagcagtggagagggtaagagtaacagatcctaggtatgttttgaagagagagacaacaagattactgatgtattgggtaagagagagatgtcaaggatgactttaagatttctgcctgagcaaatgtgaaggctggtgatggaacaaatggaaaggggaaggttgggaattcggtcttagatatattgagtttgaagtgtctattagacatataagcaaagatgttaaaaaaaagcagttgcacatgagtctggaatttgggagtgaaatctggcctagagatatttgagtgtcaccagcatatagatgatatttaaggccatgggactggatacaattataaagagagtaagtgtagattgaaggatgagaggagaaccaagggctagtcctggggcacaccaacattcagaagtcaagaaaaatagaaggaaccaacaatggtgactgagaaggagcaactaccaaggtagatgcaaaggcaaacaggtgtgatgtcctagacactgtgtgaagaaagcttatcaagtagaaaatgaagatcaactttgttgaatactgctaagtgaaggaagagggctcagaaatggccactagatggagtaacgtgaaggtcactgataactttggtgagaggagttttggtgcagcagtggtaggggacaaagccttataggtttgatggaaatgagaagagaggaactagaaaaagaaagaagaacaaagagctttgctgcaaaggggagcaaacaattaaaggaatacttgtcagggaaattaggacaaagagaaatctgtatctgtttttaaataatgtgtgaaaaatgagaacaacccattcaagatgttggtgacataagggagaaagggaggaattgctagagcaatgtctttgagtaggcaaggggagtggcttctagtgcacgagtgaaggcattacatggggcatggaaaattcatctatgcttaatagaaaggaaagcagagtatatgagtacagatgctgactagtcgggaaatggagtagagtctggaagttctcctcttattcctgtaattttttcagtgaggtagaaagcaaggtgaacagttgagaagctcacttcacctctaaagacatgcatccactgataatgaagggatggcaaaagatattccatgcaaatggaaactacaaaagagcaggagtagctatacttatatcaggtaaaatagatttcaagacaaaaactggataaaaagacaaggccattatgtaatgataaaggggccaattcagcaagagaatataacaacaataaatatatatgaacccaatgctagagcacccagatatataaagcaagtattactagagctaaaaagttaaatagaacctaatgcaataatagctgaggacttcaacgctccaccttcagcattggacaaataatccagactgaaaatcaacaaagaaacattagacttaatctgcactgtagaccaagtggacataatagatatttacagaacatttcacccaacaggtgcagagtacacattcttttccttagcacatggaacattatcaaggatacaaaacaagtaccccaaatttaaaaatacttatattaaatatattttctgaccacaatggaataaaactagaaatcaataacaagaagaattttggaaaaaatataaacgcgtggaaatttaaaaatgtgctcctgaatgaccattaagtcactgacaaaattaagaagaaaatttaaatagttcttgaaacaaatgaaaatggaagcacagcatattaaaacttgtgggatacagcaaaagcagtactaagagggacatgtacatcaataaatgcctacatcaaaaaaatagaaaaacttcaaataacctaatgatgcatcttaaagaactggaaaagcaagagcaaaccaaacccaaaatttgtagaagaaaagaaataatacagatcaaaacagaaatatacaaaacagagactaaaaaaaataaaagatcaatgaaataaaaagttggttttttgaaaagatacactttcaaaacataggaagaagccaaccattttctcaacacgttagctgctaccaccttgttccagcctatcaactctcacccagattttcgcaacagtctcctgacttgtctccctgcttttgccctgctacagatgtccaattaaaatgtaagtcaaatcatgtccctcctctgctccaagccttaaaaggcttcccattttatccagacaaaagtcaaagttgttgccttctccccagcttccttctgcagcctcacctctgcaccgtccacactaccttcttgttgtctctctctctctctttcttttttttagacgaagtctcactctctcgccctggctgcagtgcagtggtgcagcttggctcactgcaaccttcacctcccgagttcaagtgatcctcctgcctcagcctcccgagtagctgggattacaggcgcccgccaccatgccaggctaatttttgtatttttagtagagatgggtttccccatgttggccagactggtcacaaactcctgacctcaggtgatccgcccaccttggcctcccaaagtgctaggattacaggcgtgagccaccgcacccggcctcttgttgtctcttgaacccaccaatcatgaccttcacacaggaactttgcacatgctcttcccactatctcgtatgttttctatggttcacctatccatcttcctcaggtctttactcaaaagtcccacaatcattgtggcttccttgaccatactacttaaaattgcaacttgggtcctgtaaatttcctattctccttccctgctctgtatttcttatagcacttatcagtatctaacatacaatatatttaatttactcattcagtttgtactctgtctctccccatttgaaagacaaaaactggaaaaaaaagacaaggccattatgtaatgataaaggggccaattcagcaagagaatataacaacaataaatatatatgaacccaatgctagagcaaccagatatataaagcaagtattattagagctaataagtagtcaaagacttgtatcttgtttacaatgctttcttcagtgcctagaacagcaccaggcacatattttcagaatgaatgaatttcagaatcatacagtgaggccaggacttgttgtgttgtgtagttactccacagacatgagatgtgccatccacctaaaatttggtttggttgctgacagtgagaatatctcacatgcaccaggaagatatgaaaaagtttattactcacatcatgtggctttctggggatagtaggtctggtttccaagcaggtctgaaagtagccccagagagcagagaaacgatatggagttctagtgtgatttggcgatggggctgggatgaggattcccatgcgcaaggtagggcttgtgcagtttgaacctcctgctagtgccaaaggagtgagcacctgaactttcttatcagctttcccagatgtagggctgaagggtcaggcagggagaggtggacagtcaaacatcagaaatggggtcagaatgttcattacaggtcccatagcaagtaggactgtttgggcatttcatattctttgatcctacctggcacctagcacataagatttgcaagggatcttacaactctaggcaaactgtcttctttttcagatgaagaagactgagtccagtcccactatgtcattctgtctctgtagatcacactttgagctgactcaatagctggcttccctatggcaaggcctagggctgtggagacttaaaaacaatcttgcgcaattttttagactctgactctcagaacccttttctataaaattcttgtaatatctactgtacactttgtcagactaagggattcaatgaaagaatgttaataatgtgccatcatatgattatgctctgtgaagagtcattgctagggtcagaacatggtggtctctagttaaagaccatttggtctaggcatatttaagagaacacttttgagtataaaataggtagactataattatttaattttatatacagtaacagaaatgaggaccattgctttgtgtgggtttgatttttaatatttttttttctttttggagatggagtcttgctctgtcacccagggtggagtgcagtggcgcgatctcactgcaagctctgcctcccaggttcatgccatcctcctgcctcagcctcccgagtagctgggactacaggcgcccaccaccacgcctggctaattttttgtatttttagtagagatgggatttcaccatgttagccaggatggtctcgatttcctgacctcgtgatccacctgcctctgatttttactttttatagtgaaactttcaaataaacagaaaagtaaaaagattagcataatgagcataccaataccctttacatcagtctaacaattgttaatatgttgccttcttcgtctacttgttttggttgttgaactaaagtaaattaaagttacaatgatattttaccccaaaatacatcagtttgtatccccaaaaaataaggatattgtcctatatggctatgatgtcatgatcacactgaacaaaaataatgattccttaatatcatttaatatcagtccatattcaaactgtgttaaggcttcagtaggatgtttcatgagattttgagtcaaattctcctttgtggatctgaaactcctcattccccaattcaccgtgcaattaatgatttcttccctgtttatgggaaacagatgggattagcaaattgtgactgttgcttatttcccaaaagataaatcaggcacatcataataaggaggggaaaagtaatgtttgtaaaattccttggacaaatctctatcttgcaattatgtgtatttgcctttatgtattggagaaattctgagcattaaaccagtctcaaatgagacagtaaagttctgattggatgtcaccatctcccataattttccccagaatgtgtgatgaaagggctccagcctgggtgacagggaagactgtgtcaaaaaataaataaataaaaatgaaaggcttgaaaataaaagaaagtaagcattgagatagtggtttcaagtcactaagagtaaaaaaagtaaaagggccactttactgttttccttatcttccaatcaagacagcgtcatatattttattttattttttatttttttcagacagagtcttgctctgttgctcaggctggagtgcagtggcatgatctcggctcactacaacccctgcctcccagattcaagcgattctcctgcctcagcctcccgactagctgggattacaggcgcctgccaccacgtccggctaatttttgtatttttagtagagacagggttttgccatgttggccaggctggtcttgaacttctgacctcaggagatccacctgcctcagcctcccaaagtgctgggattataggtatgagccactgcacacagccagctttatatattttagagaaccaaaaccaggcatagccccaaagagggaatgatgcctcgttattgccaggtcttgaataagagggtggagaaatgggcacacatgtgaaggagagttaattacttgagcacaaaattttatctacttccctcaattcctcattttgctttgcatgggaattctgtatcagagaagttggagagctttaaagattttgacttttcagttgagatgatgccaattctttgtaattttgttttccactttagttgttttttcaaaatgatttttttcttttttttttattgtaggctttgcacttctgggaggacatccttgttttcttaccacacaagatattcatttgggtgtgaatgaaagtctcacggacacggcccggtttgtaaatattttcttctctccaaagctgatttcagaatctgatggataaatttcaaaaataaaacataattctctttaaataatggttttccctctaattgttctgttctccattttccctctttccctgatattctgaatacctctccctcatcctgtggccactttccatcggttgaaataatttttcttggcaattttttgaagaagcttctgatcataaaatttcaaacttatggaaattttgagttcatcaagtatgactcttagatttaacagttgaggaggaaatgaaggtccagggaaactgacattcagtggctcataactagttactatcagactaggtaataatattaataactactaataacacttattgagcatttattgtgtgctaggtatttttctgacttgtttaatccttataacaacccagattgtcataaagaagtgaaacaacttaattaggcacagactagctgctataacacaaaatctcaaatgtcaatatgctaacatagtgcagatgttcctgattggtaaaagggaagaacaggttattaatttatgtgggttattcagggacactggctgagagtgattctaccatcttcaacatgtgacctccaaggtcagtttgggtgttaacatccagccaggaccaaggagaatagagcatggagaaggcatacttgtttcaaagccaccttagcagggaagcagtacaaacaattccacttatatttcattaggaagtactagtagctcactcccatctagatgaagggagagacggggaaaggctcttccccactatattataatgaaactgaagcataggcctcctgactcctcatgcaatgctcataccactacatcatgtctggctaaaaaatccagagcaaatgtctttgttaaaagttttgccctcaaaagagaagactaatgattcttttcctgaaaatgatacgccatgaagttatttcttgcagataacgtctgctttttatggcaaccaccctagtataaagaattcacctcatttgacttgctgaagagatttcaaataactcttctttaaaccttttagttatgttatttcagatgggacaatgaaagtattaagaagtgtgattagcttctggattctagggacaaaaggaatcaaggaacataaattttttcttccaaataatctgcctctgacttggattatatttgtctgataattctgcttccacaaaagtgaaaatatactttattcaaaagcaaatattacaagctgatcaagggatgaagccagagacatacccaagcaaagtttcagtgaggatcctctatataggaccaggtgaaagatggtgaatgagtcatatgtaaagcactggttggaagagggttcagtgggaggaacagctgagcatccaaaaaaggagttgagcagtgcaggttggcagtcagaaagaggtcaggatccagaaatcagtgcagtgggcaggatcccaagatcaagagacaaacagccaagcatgggctgaaaattgaggatgggtataaacgtgctcttttctgggcttgctctccacacaattctcactgcaagtccttagttagaggagctctacatagatgctgagcaaaacagtctgcttacagttttttttttttgttacaagttccaaaatgattgggacattttgagtccatataattattatagttccattgctacatgaatacatgggtccatgaaatggagtccatataattcattttgaccattttgtcttatccaaaacactgaaaataatagctactccttaaagattgtctgccgtggacctcttgtgctattatctctaaatcttttttaaaatcttgcaaagtaagtattattggcctggttttatagatgaggaaagcatggctcagagaagttaatggagcttagaagctgactaagtcagggtttaaatcaagctgtctttattttctaaggccgtgttgttttgattaccccataatgctgcttctattcagcccacgagaggggcagcgaaacaagttatagaaaatattgggctgggcgtggtggctcatgcctataatcccagcactttgggaggccgaggcgggtggatcacctgagtttgggagtttgagaccagcctgaccaacatggagaaaccccgtctctactaaaaatacaaaaattagccgggcgtggtggcgcatgcctgtaatcccagctactcaggaggctgaggcaggagagttgcttaaactcgggaggcggaggttgcagtgagccgagatagcgccattgcactccagcctgggcaagaagagcaaaactccatctcaaaagaaaagaaaagacaaaaaaaaaaaaaagaaaagaaaacattgacaacattgacttgcacgtcaagaggtccccaggacaacccagaggtttgatgattcactaggagggctcacaggactgagcatatagtcatactcatagttatgatttattacaatgaaagtataccaagcacaatcaatgaagggaaaaggcagaagcaggaaaatgaaaggagtttctgctttgtggagaaaatgacagattaggcactgaacatattgcattaaagtttgaacctctgagtgcaaatgttcacaagtcattggagataaagaccttgagtgaagttgagagctgaagaaatataaatataagctcggtggtaaaaattacctccatggtctcaatgtgggagaattgcagaaggctgtgccatgagaacaggtgcaattaaggagggggaggaggaaatcctcagggcacaaagagaacaagcatagtacaatatcagaagaggctggcatgggagatgggggatgtcagaaaaaggagtagagtagctattgtagaaatctgactttcttttgtgtacgtcattactgcttaatctgccaaaatatctgacaaacaagatatgctgggactcagaaattcaataaagctaaattgaagaagacaagataaatctaccaccttccacagatgcaattgaataggagatgtaaggaagcaaatcttaatgacatctaccttgctgatatgcaccttgtaaccctcagcaatcgcttcctttgctttttgtagaagtttaacattttaaggtgcaaagggattggaggatgattaaatgacattgctggccctttcaaatcaaaagaatcatgcatgcctgacactgattgacggtgttgcttcttcattgctggtccagctgctttgggggcctggtcgaataaaaagtgcctgcacattgttgaaagaagagcctgagggagaatatagtgagtgtagcaaccaaaagaaaaaaaaagaaagaaagaaaaccgggccagtctcttgaaagctgttaaatgcaatttccatagtgccacttatttgttcaaatgatttaattgttcatttattcagaaatagttattgaatgcctcatttttcttccagacattgttttagcactgagaataaaatgctgatcaaggctgggtgcggtggctcacgtctgtaatcctagcactttgggaagccgaggggctgggggaatgggggtgggtcacctgaggtcaggaccagcctggccaacatggcgaaaccccatctctactaaaaatacaaaaattagctgggtgtggtggcgggcacctgtaatcccagctactcaggaggttgaggcaggagaatcacttgaacccgggaggtggaggtggcagtgagctgagattgtgccactgcactccagcctgggcgacagagcgggactctgtctcaaataaataaataaaataaaatgctgatcaagtcaaacaagtttcttgttagagtggaaattgcattctggagcgaggaggcttttgctaaacaaatgaacaaagcatgaatagaagagcaggttgaaataagtgctatgatgaagctaaagccgggttatttgttggtggggtggcggctgccttagattgggtggtcagggaaggcctctctgaggaggtgaaagttaagagctcaataaaatgacagagccaggtacgcaatgctgtaggaagagtgtcacagaaagaactgctgatgcataagcctaaggcagcaacaagctggatgtgttcaggaacagaagggaagccattaatgttctaaaatcttcaaacaaatacattttgaacctgatttttttttaaaaaagcaccttacagattggtcctcagtctcacccaccaaagaaaggaaagataaaatcagaacaaggaataaaaatcctaaatacacattcaaaatccaatgtattgtacagcagatctttagaacttatttatggccgggtgtgttggctcacgcctgtaatcccagcactttgagaggccgaggcagacagatcacctgaggtcaggagtttgagaccagcctggccaacatggtgaaaccccatctctactaaaaataaaataaaaaaaattccgcacacctgtagtcccagctactagggaggctgaggcaggagaattgcttgagcccaggaggcagaggttgcagtgagcccagatcctgccactgcactccagcctgggcaacagagcaaggctctgttaaaaaaaaaggccgatgcagtggctcatgcctgtaatcccagcaccttgggaggccaaggtgggcagatcgcgaggtcaggagtttgagaccagcctgaccaacatggtgaaatcccgtctctactaaaaatacaaaaattagccaggcgtggtggcgtgtgcctgtaatcccagctactcaggaggcagaggcaggagaatcgcttgaacccaggaggtggaggttgtagtgagctgaggtcacagcactgcaccccagcctgggtgacagagtgagactccatctcaaaaaaaaaaaaaaatatatatatatatatgtaacttattcattcatcttctataactgaaataattgttgaacagcaatgctcattgccccccacctccaacccctggcaaccaccattctactttctccttttatgtatttgactattttaatacttcacataggtggactcatgcaatatttgtccttctgtgactgacttatctcacttagcataatgttctccgcgttcgttcgtgatattgcatatgccgggatttccttctttgtaaggctgaatgatatttcattgtgaatatgtaccacattttctttatccattcatctgttgatgaatacttaggttgtttccacttattggctattgtgaatagtgctgcaaggaacacaataatacaaatatctctttgagtttctgatttcaattactttggctaaatacccagaagtgggctaaatcatatgataattctatgttcaatttttcaaggaacttccacactgtttttcatagtggtggcaccattttacatcaccaccaatggtgtggaagaattccaattttccacatccttgtcaacacttgttatcttttgtcattttgataatagtcatcctaacaggtgtgaagtgatattgcactgtggttttaatttgcatttccctaattattagtaatattgagcacattttcatataccttttagccactcgtatgccttttgtgcagaaatatctattcaaatcttttgcctatttttttaattttgacttttatttttttgctgttaaattgtaggcattccttatattttggacattaaccccttgtgagacacaggtgtgcaaatattttctcccattccataggttgccttttcactctgttgattgtttcttttgctatgcagaagctttttagatctcatttgaagtattattacaataaaaaagtcttacatttagagttagtaagattttaaaaattagatcataataaacaagtatcccaaagaagatctgacaattaaggagagaaaaaactgtattgttcttttcttccttgttacaataataaaacctattcactatacagaatattgtggctgaaatctcgttagcttggtctgagttgcattttgtataatctagaggtgactgaaggggagcactgaggtggagctgtccactgatattttggaggagctgatatgttggagtctctaacaccacactcaggtttgatcatttattggaaggactcacagggatcagcatacagtgatactcatggctaagatttatcacaacaaaagaaacaaagcaacatcagccaagaaaaaaggtgcatgaggtaaagtctaggggagactaggcacaagcttccacaagtcccctcccagtggtgtcacacaggatgtgcttaatttccccagcaaaccagttcccaaggcttttactggggactggtacaaaagtgccctctgcctagtgtgatcccaaattccagacacccagaaggaaagcaggtgttcagcataaaacatagtgcatatccaaacagtttgggcacagtggaccacccttctcatttctgggaatggtgggaaccctcctaaagtccaagttcctagatgctagccaagggtcagccttgtaagcagccctttgaaggacagccacctcaaggcgctatgttagcttttttctgcataatcaggctctcatctctcttctgaattttgctcaatttcttttacctagatgtactgtaactggtaagggagtgtatgttatatccatgggaagacagccttaagatttgagttgttttcttgcttcagcatggatccctggaggcctaggttcccctggatagaatcagtcctattgctcacttccctttattgaagagtctctcttaggagctccttctcaccccctaacatatcagaaaacacaaaacatacacatagatattcagttaagtttacttcagatgtgagggtattttcagattttgtcatttaccaggtgctctactggggttatgaactggatattctttttttttttttccttgttctgggcttgtccttttagatgtgacaccagaagtgaccaccttcgcgtgactcagatcactgattttttagaagatttaaatcatatggaatttagcaacagcaagtggggcattatcactccagtttcaaggctttctgtttcttctgtaatgacagcttttcatgcctaatgctcagcgtactactgaaaagtgcataatagcttcccagtcatttgtcttctaatatagtacttagtaatgcagcttcaggaaccacgtgtatgaaaggctccatataaaaccaaataatgtaacactgttctactctaatttctttccctatagatgtaatttacttatggtagtgattgctaaaatgtgttcagctaatttgtaaaaccagtagaaaagaaaatgaatgtagaccactatattagtttcctatggccaccacaacaaattaccacaaacatggtggcttagaacaacagaaatttattttcccacagttctggaggctagaagtccaaaatcagtgtgtcaacaggaccacaattccctttccagtggctttcagtcatccttggcattccttggcatcaccccaaactctgcctccatctttgcctgggcttctctgtgtatcttctcctcttcttataagaatatctgtcattgaatttaggacctaccctactccatatgacttcatcttaactaattacatctgcaaatatcctacttctgaaaaagctcacactttgagtttctaggtagacatgaattttggggaaatgccattcaacccactataaccacatatccacatgtccctatgacaccataaaaggggtttccaatcattgctattctcaaataatgaaagttatagagggatttgtggatgaggcccaatcctcaagaggagtgaaccattgtcatattaaaaggaatatttataaaaaaaaaagctggaatactgttattcaggtatttataccaattatgtccagactaaaaatgttaaaggttttacgatttttggtaaaatgttttaaaatattggtacctaatgggaaatatatatctcatgaggtagtaataaattggtacctaatgggaaatatgatacttccatgaatctttacagagaacaccaagaacccagcaggtatgaaaattctatatttttgggaaaaatgattacaaaagacagtctctcacaccatgaacaatgatatattctcttagaggcagtgtaccagagcgtcaaggacaggggcttcaaagcagagtcacagtttggttcaattcagagctctaccacatgctagccctcatggtttgggccagatgcttctgagtctcagtttcctcagttgcaaaatggagatacttatacttatcttaatgcattatatgagggtaaatgagatcgtgcttgtaaaggacacacgcacagaagaaattcaagtaatgttggttgaatcaagttatgatctaacccaatctcaagacaagcactgactcaattttggctatctctgtggttttcctaaacaggttacactgacccactgaacttccattagcatattttgaagaagttattctaaatgccattataccccattcatttttctctaaggtcttcaaacttgggatctaacatttaaatcaaaacaacctggccattatagatccttcattaataaattgaatatggcaattttattcaacatctctggcttcttccaacaccagcccatttgacaagaacccatctaggtttgctgagagtattatctatcttatttcctcatcattcttatgttgatataactaaaatcatctgggtagagatgccagagggctagaatattctgtttcccagagggagattcagagagtttatctcataatcaatttacattggggatagagattaagtctgcttaagtctccttttgggacttggctgaatttgacaaaaaataaaatcagaaacatccatttttaagtgattacagggttctcaaggatgtaatatgcacaaccaaaacatccttcctctatctcccagtcagctgttcaactggtaagagttgtcagtgaaagaaactggagtttagagggcatgcagtctgattcaaacaaggcaggatggagacaaaagagaaaatggataacaggaccctatgagaatacaacctctgtttgcctttggcttttgagacacttgcaccatgttccaatactttaggaacaactgaactccttttaagagcaccaggattgctgtatgattgtccatctcatcaacatccatgtttgctcatcaacatccatgtttgatctggcccagcacactacttgttttttattttttagtgtttgttcacccaaccacactaactctgcaccaggttttcctggggtcatgagaggctttgtttattgtctttttttgtttcattttgctttgttttgtttcagccttcagggtgttttcattaattcctaaataagtttcaaacttataccaaaagaaaaaacaccaagcaacaacagaaactaagggttggaaaggatttatttatagcaaccatccttttcatggagagagtgaccatcactctctcaaaatggtcattgagccctgcataaatcatcccatcattctcagcaaactattgcaaggacaaaaaaccaaacaccgcatgttctcattcataggtgggaattgaacaatgagaacacatggacacaggaaggggaacatcacacaccagagcctgttgtggggtgggggaaggggggagggatagtattaggagatatacctaatgttaaatgacgagttgatgggtgcagcacaccaacatggcacatgtatacatatgtaactaacctgcatgttgtgcacatgtaccctaaaacttaaactataaaaaaagtacccagtactaaggcactctttatatactcagctattttgtctgatatctatgtagtctgactgttctcatcaaaagtttatacaatctgactgagaattatctttgaaattgagttagaattggtcttgctatgattcttctcattgttctcccattttattagtatctttataaactcattggatgctaatacatttgaaggtttcaatttattataattattattcttattaattatcaaattgtcccatatttggtcaatgtcatctttgttcaagttgggtcattttgacctaactccatcagtcttcgataactctcttgctttgtggtgtgacaagatgttccaggctcatcttgtacatttctttattaagaccaagaattagccattgctctaagaagacttggggcattttcaattactttcaaagtcacacttgggagaaatttcctttcttgaatgatattttgtctgattattaaaataatattccttttgatagaatatactaaagaagattaaaaaaatagagccactgataccaccatcatccagaaataatggatgttaacattttatctctggaaccatctttccacttaaagtttcatgccgtgcctttcctttttctaaacagtaggaaaagagatgatgaatgaaactagacattttaaatatttagacaaaataggttgaacacatgttttaacttgttaatcatttttgaaaaatcctaatattggccattaaacttccagggcaagctggtatatgtgggaaactttaaatttgagtaatttggattttgcaaaagtctttttgctaccattgttggctaatgccaaagattgtctgcagagctgtaagaatgcactggaaggcaaacagtactgtatatattaatagaaatgaaaagagggtaaaatgaaaagtcattatagaaccagagagtatttttttaacttatcaacttttcatgtgtagcatgtataataaagctcttacaatgtttaaagctggggttttagattgatggagagctctataaatcccagattactattaatgtgcttgtagtccagctctagttacagggttgtcattgtttccagtgaaaaggtttgtttttattttttaaagatctttagtagcctggaagaattaaaatggtgatttctagcaattttaagcatgaagtagataccaatgtcattcacaaaataatatgaactaattgtctagttaagtgtctttaatatctttgttcccctaagtgagtccaacatgaaagcaacctaggagctgctccctctccacccccatatcattggattccaccttactcgaagctcctgtggctgaaagaggactaaagtggcattttctgccaggctttgtcacgctcccttttgcccacaggtgctttaacctccaaggggctttttgtgcctacagggatattccgcactctttgtcctttgtttacagtccaatttcataaccttatgaatttgtcaaacatttagcattttttaaacctaaaataataaacgttcctcaaagcacagctaccaagtcaacggcgtaaatagcccttgggagcttttcagaaatgcaaattctcaggcctcaacccagacctcctgaatcagaagcagctggctgtattttaccaagtcctcctggtaattctgatgcatattcaaattttcattgctttaaatattcacacactacttatacaaccaataaatcaaatgtatattaagtgaacaaaacgaatctactcaaccatttacacattgattgcaaacttaatgaaatgcttttaaacatttaacttaatcacaagcctaacatttcagatttccctgcattaaacatcttacaaaggaaaaaatacacgtaaaataccacgttgtttacatagccgattattattttgacaacaaaactgggcacaaagctattaatatcatagatttaattttgtttttttattcttaaatctccttttatttttacttttgtatggtcctggaatttaaacttctgtacattgctggattgttgggaattctacaagagactctttatactttctcagggtttatgtaatttttccagactggaaagaacaaacatatcacctcgggaagtcagggatacaggttaagtggattactggccacttaattttggttggttagtgggaacgggttgctaaattcaaggtgacttaaactcaagttgctggccactagacaataattttttatcacatagtttttgttttttgtcatggaatctatattgttttctcattgctgctttaacaaattaccacatacttagtggcttaaaacaatacaaatatattatcttacagttctggagggcagaagtctaacatgagtgtacagggctgtgttccttctggaggctccagaggagaatccaattccttgtccattccagctttcaagggctgcctgtatccttgggcttgaggccccctttttccatcttcaaacctagtgtcttcatagcttctcctctcatttctaacctcctgcctctctcttattctctagtgttatattgggcccacccagggtaatctccccatctcaagatcactaacttatgaatatgaatcttcaaaattccttttgtcaagtaaagcaatacattcattggttctgtgggttaggacatggacatctttggggaccattattttgtctaccacatgacactttttgtcaatgtatttcacatttttactgtgcatacacatatacacaatgtattttttaattaggctttacaatatataattttattgcccggtttacaactaaatatattgtgaacattttcttttcttttataacagttaaaataattgcatagtttggagaaaacataatttactaagcaatcttgttggggaaatttaggtataatttttttccaaggagatttcattcttttacaatgctgttagaaaaaaggagagtctgtcttatataactttctatagatgatggaaacttgcccttcaatttagccttttaacttgcttctctacatccacctaatcatcagtcaagtaattcattttcttttttcgtgtccatctctcccatttgcttcctcttttttaccccatctccctggcacacatgcagacagatttctattactaccccagcgctttctgatccttccctccatggcctccctttaatgaggctttctttcattttaaagagaccattttaattgattttgatcaactctactcaaaactttatcctcagtttcgcattaggattagcctttaataatctgaagatataattcaattgtttaaaagaccgtgttaataagaccttggtagagttacatgtatcaagaaacataggacttgggcacaatgtacatacggctgactttcttttgaaaaaggaaagtagtttctgggggggggcagggcagaggtaagaagtaattggtacgtgaaggaagtgaggaagtgttagggaccattatggaaatgtattctttttttgttttttgagacgaaatctcactctgtcacccaggctagagtgtagtggcatggtcttggctcactgcaatctccacctccctggttcaagtgattctcctgcctcggcctcctgagtagctgagactacagtcgcatgccaccacaaccggctaatttttgtatttttagtagagacggggtttcactatgttggccaggctggtctcgaactcctgaccttgtgatctgcctgcctcagactcccaaaactgtattcattattttaaggcaactaacaaatgatcttctttcagttaggacattggagcagcagactttactggtcatgaaatttgcatgatatctaaagttgttatttctggaaataggtaaatgtcagttcatagtaactttgtatggaaaggcatgtgccagctagcataaaagtggtacatgcagatggtagttttccagagtcctgggagccatgaggtgctcaaacatcacaaggccatcacaaccaggtagaaatgcctcaggaaagcagaggggttggccatgccagcatttacacataaaacgcttcttgggcagccagatgacatggtgcacagacccacagttctctctgcacacaacatgctcacagttccatccataggaggaagggaagacacaaaagcaccccagcgtgcaggttcccccatttggacagcaggttctgttttgttccttactgtcctgtgtccccatggatggcacaaactctgaaataaggatgaattgcaggctcctcctggggctgagtgctgtcccctctgaaagccaagtcttcctgagatagacatgcaagttatggtggcccaacccaacctggccaactaattctagttcaaatgcttttgaaatggccatgatcaaaattacactccgtcattgtcccctgaacgtttaggcaggccagaggatgagagagagcagccgtatttttatcttttaaattgattctgtttttttttttttgagatggagttttgctcttgttgcccaagctggagtgcaatgcagcctctgcctcccggattcaagtgattctcctgcctcagcctcctgagtagctgggattataggcacatgccaccacgcccggctaattttttttttttttgtatttttagtagaaatggggtttcaccatgttagccaagctggtctcgaactcctgacctcaggtgatccgcctgcctcagcttcccaaagtgctgggattacaggcatgagccactgcaccctgccatggattctgatttttaaagaaatttagaagatttaagttttgtttgtttttaatctctggcagcacatgactcattgcaatatttaataatatattaacctggcctggtttcaatatttaaaaacattcatctttcttattggcattgtgttgtaattaattagttaaatcatcaaaagttttcatttccagagaaacagaaaagtgaatcttaaaatttagacttcttagccaagtgcggtggctcacgcctgtaatcccagcactttgagagtctgagacgggtgatcacctgaggtcaggagtttgaaaccagccaggccaacatggtgaaacctcgtctttactaataacacaaaaattagccgggcgtagtggcgcatgcctctaatccaagctacttggtagactgaggccggataattgcttgaacctgggagggagaggttgcagtgagccgagatcatgccactgcactccagcctgggcgacagagcgagactccgtctgaaaaaaaaaaaatttagactactttttatggacatttaactaagttagtattttggagtaaatggttattatcgttttcctcattggaaattgcatatgcgactggtgctagccaaccgctggactccttttctagttcacttatatatgagaccacaaatgctgctgaggcctgtttattcatggtacagtttctactatttctaggactgtttggcttacaaattatgttagtaatttgtggcttatgcagataaaaacaatacatatctatactatatgaacagaaatatacttaacaaaaacccacaaatatctatctatagttatatataaacactttcctacttatgtaagtaaataaatttacatgtacataatattcactcttctttgatattactattataattttgtacattttatttacattaacttttttcttatgtacatcatgtccctttagaagcataatttatttcatttcatgatctttattactacaaatgatcacaacttgaaaaatgggagctcctttaagctgactgtttttctttcagcagtgcctctgccatttaaaaaacaaatcactcttgtttcctggcaagaacaaaatgttacagacctattctgattttattctgcccaataacgtgaaactgactatcctctaatggtttctggttctttttttaaaaatagaacaatattagagacaaaaatctggtcactagggatgtttacaagtgtcaagtggggaaagactacagctactgctgctgccttgggacttctcttgctagcgactgagcttaaagaaaatacgtcttttataagtgtgtaaaatcttgttctttccagtatagcttatcatatcgttatcccttacttttcttattgtatgagatttcagcaattactaagagtttcttcctctacattgatccactgtgtcacccagtggcacagtagcccactttcctcccacctcctctctcactccgttttctaggacaatggttctcagcctagtcttcatactggattagcttggggagctttaaaaatgttgatatgggtctcactatcatagcttctgatttaaccttccaaaaagcagaatatggcatcaggattttgtaaaagctccataggtgatactaatgtgcagccaaagtaaagaacctctgttctagaaaagtgttgcaacctgaataaagccaaccaggcatactcccatgaaattacaccacagaggttccagggataccagcttgacattataaacagaaaaattaaatgcatgcttatcttttgactgctttgcttcaggagttttggggatggggacttgctaaagagagaaaaacacacctgcctttttttcagtcttcttgaaagactcatgtgtacaggtcgttgacttctccaattgttctgctagcatttctgtctttcagtctcatcttcctcactccttcctaaccttgctctaattacttcaaggttttaaaaggccttgatttcttcatctttgaggttaagataatgtctgcatgtgacacacactaaatctagcaaaattcaacaacatactgtaaagttcgagaaaaccataacaggttggcagcctaaggtcctagctgcctaaaatgatttgagaggctataatagaagtcaaatctgcttttctggctatgagattccagaaggtcaactgcagtgttaatccagactttttttatttgtctgtacacactttagggagtgctacatgtttaaagaagtctgaagtatgacctctaggattaaacacccctctgcccccaccctctccttctctctctctctttcttggggttttagacatcataaaattaaccaattcatctgatatagggaattgatagttgattataattatataccttattgacatatctacctccacttaagttacttttccatgacagaagcttgcattcttatagtatgaaaaacagaatgtctgttttagtaagaggacaaaggcctaggacctactctatttctgtgtaatctattagtattagttcttcacttagttccgatacacacccaagtctgggaaccattgtcttagggcatcaaataagtaagggtagttgcttctctaacgagaagggccttaacagaaggtggtgaactattctttgctcagaggagtttagctgcctttttccctcaattccctccctgccaaggatattatagacagagtcttctgtttttgtgggctgccatctcagaagctttgtctagtcttgatatattgcctggttaggattttaagaaaataatagatgatgctttcaaaaatatggcagtctcaattccctctttcttaggagtctcaaactttaatatgcaaatgaatcacctggaaaccttgttaaaatgcagattctgcttcagtaaatctgggtggggcctgaaattctgaagatctaatatgctctcagatgatgctgatgttgctactctgaggggcaaggtgctagctttggttctcaactttggcagcacgttacaatatagtaagaatatttttaaaaataatgatccctaggtcccactcctagagattttgatttttctgatttaattgatagagaatatggcctgggcatcaagagtttaaaaaactctccaagttgccaggtgcggtggctcacgcctgtaatcccagcactttggggggccgaggtgggcggatcacctgaggtcaggagtttgagaccagcctggccaacatgacaaaaccctgtctctactaaaaatacaaaaattagctgggtgtggtggcgagcctgtaatcctagctacttgggaggctaaggtgagagaatcgattgtacctgggaggagggggttgcagtgagttgagatcacgccactgccctccagccagggagacagagcaagactccaactcaaaaaaaacaaacaaacattctccaagtgactttcatgtgcagcaaaatttgaaaaccccttgtcttagtccaccatcaaaagttaaccaatatcacatttttttaaaaatggctcttttattcacttctcatgctataaaatatagcgcgcttagatagttcaaagcagtggtttacaaatctctatccccactgaccctggtgtggagaagcttccatcagaagtggtagaataagaaaaataaggataagaattatatagtaaatttcataaagctcaaataattcatttcaaggattcttctttgaaattgtctttcacacctttttgatgttaaaatatcctttttaaattaaattaaggtagtaacattatacctgtttatttgcttttctcatgctcttaatttggtaaataaagagttgcaaatcttatgttgatctccacatatttttggaaatcttgctggttcatgaaatttgaaaatctgggagccatgggcatgataaatccattaaaaattagaaaaaatctgatctttaagtctagaaaaatattgttataggaatatagtttttaatctttgattctctaatccctggggccaagcagtccttgaattttgtaagcaccagagtttattgctttctgtgtcagttcaggtccactaagcagatttcaagaaggaattagacttgcaagagatttattgagggaaccaccaagaaacataaagagagaggcagcaggagtgggcaagagggccttcagacagggaggcaggtctgacccctgtgggaaagaaggatgcgtgggtagggagagagcctcagccagtagcgcagctctgagaaagtctcagccaggctggtggggagccccagagcacagactgtctatcagagaggtccctgtcacgcaggaatggcccagcgctattctccccactgtgttctgtcatcaggttggaacagcctggggagggtggccttggcaggaatgctgcagggcatccgaaggtgtagcagctagagtgtcagccaatggctctcctcacagcaagttctcttctgtagggcgatctgtgtgtgcacttccatggctgccacactgggacttgcaattccacagtgaaaatgtatcttttttctgttggatgatgtgaaagaaaattagccatatggcaggtcattaatgtttctccgtatatcttgcttttggtcttgtcccttttaaccaatggccatttattaattataactcatcattatgtctgctgggcccacaattatctccataaaaaatgtaaaatcgctggtcactggataagtcgtgggaggtagaacatctggcttatgtaatgaatacatgtttaatattaccttttaaacctgtaatgttggtaggttttcatgtagtaaaaattctatttattagtatttcttgttattatttctgatcttatattaaataaggcattattaagcataattatcttagattatctttttcttggtttgccacagtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggttggtttatttatttgtcttacaaaagagcaaaatcaaataattcctgacttgctttaagtgaaacagtttacttaaatcatggtattggtgttttattttcaaataccagcttgacaaagaattacagcttgtgtgtgcattttctggggaaaacaggacattgttaaaaacagactctaagatcgctctgcactcaaccctattcccaaacccttttagcccatatctcatcttatgttctgtcaatccctttgatttttcggtgccatatttaacacaatgaatgaatagagaacactggagcatacaaaatggacaagccatatgtgattctatagacatcaggtctgtggcttgggagtgaagactggtggagtgtgctttgaatattcaaaaaggttagttactaagtcactctggaagagggggacactttctatcattttaataaactggttatttaaagtagggttaagaatatgcagaatttatagaattggggctcaaatttagccattctagtcctcccaaattaggaacttgaataactttgaaagattcctcttgtttggtttgccacagccaatctacattatattgcccctggaaatcctaacagccatggtttctatgtctatggataactctgaggagacaagataaactggataggcccatcttcttccacatttgaataaactacacacatttaaatgtgaggttaagctcaaaataaaacactttggacatgaggatgagatccatgcagagaagatgatataattatgtcagataccaaagtggctgtctgtgggtgtggctttacatatacaccagataatttaatgcttccccctggggctttatcattactagattataaattcattgagggaaaatgagctgtcctattcatcataatgtcccctgcaggaccttgtgcaatgccttcatataggagacacttaaagtaggagctgaatgaataaatagcagcttgttaagagcatggaatctaaatcagatggatctggaattaaattctagcttagccaactagtagttctgtgatctccaaattgcttagcctttctcttttttaatctttttaaatatataaaatatatgaaacctacagacacttcaagaaaataaaacaaacattcatgtgttcacacagttttgtcaattcttaacatgatgttgatactttataattctttgctgtttttcaataaaacattaaagatagagttgaagcccaccatgtaactctgcctaatcttattttcttcctttccacaaatatgttattatcctgatgttagtatctttacacatatctatagccataaacaaccaacagtattattattattatttttgttattattattatttgagacagagtctcactctgtcacccagactggagtgcagtggcatgatctcaactcactgcaacctccgcctcccgggttcaagcgattcttgtgcctcagcctccggagtagctgggattacaagtgtgtgccacgcctggctaatttttgtgtttttagtagacatggggtttcatcatgttgaccaggctggtctcgaacttctgacctcaggtgatccgcccaccttggtctcccaaagtgctgggattacaggaatgagccactgcacctggccaactaacagtattattgagcatctttgtcaacttcgtataatgggaacatgctctgagccactatgctacactgttccaggtattctgtatttcccctttctcataccaaagaatttcagctccataaaagcagtgatttttgtctcctttgtttattgtatctccagggccaaggacagtgtctcagtgtctggatgttaatggtgctcatttgtatccaatgagtgaatacaactaagactcagatttgaaatgtatgaaactcttagtctctgttcaagttcatatggtgtcttggtttaagatattaagacattttaccacgtttttgggattgtacattcatattattgagttgctctgtgtaatgcaaaaaaattgggaattcattccttctaacaaggcactaatactgagattaagactatttattttaaccttagtaattgctacacataagcgaatttacgcctggatttcatctccttcatcccgtgccttttaggaacactatagctctctgaaaggtcttaccctcagctggatcggggatgggaacaatatcctgcactccatcatgatgagcgcagcgaaattcggaatgcaccttcaggcagctactccaaaggtagggaaactttttgccttgaaactaacccctctcttaaatcatcctcagatgcaattacccagtgacaaaaaaagctctcttccatttaagtatagcacaggtgaggccacagaatttaggttacgttaccagccctactattaaatagctatctggcctcttgagagtccaatttcccatctctacaataagagatagtcttggctgatgccttttattctatgagttagtgttaaaagcatgtctgaattattcctttgaataccctgctgtaggccattatgatgactggcattgtgcattaccaccacaaaggctgaagaaagcaataaaatccaggcagcatagaattctcaacccatgggaatgatactgtcatttttctaacactgcaatttggtagaaaaatgtgaatccaatgtgaggatcacagtgatggcatctacaccagcttagtatttcaaaactcaactctggggaccttttggcttagaaaatttgagccccacatggctatgaaaatgacccctgcatacttcctaccttgctgctctctcacagcatgtatggaatacatgacttctttcataggcccaatgtaaaccttttgatacacaagaaactggtaataattgttgcctctgaggagaggaactgggaggtttgaggatagaggtaggagggacactttattttgaccatacagtcatgtgtggcttcataacagggatatgttctgagaaatgggtccttcgatgactttgttgttgtgggaacatcataccgtgtacttacacaaacgtagatggtatatatttttatttatatatattctttcacatggaaaaataaatgttccagcaccattactaaatatcaaccttaggccaggcacaccaccacaggcacaccaccgtggggatttgtgtacaggtgatttattaaggaagtactgccaagggagatccctaagggattagggggagcaggacagggaaagggaagaatctaagcaaggatgccatttacagtgaccaaccatcctgatttgctcaagatcaagagatttctggggacatggggtttggggtgctaaaattgagagtccgggcaaaccaaggtgatttggtcaccctagtcccatgtcgtgcacagtcccacagaaagtagcttcagcctgatctcacaggtgagctctggagtgtaagttatgccctaaagttatcccagcattggtcaagggcagcagaagaggtggagtggtaaatcccctggcacttttgatgggaaaagcagcctggtagccagagagctgtcccctgaagacaaactgcacgcactaggtgttaaaaacactgaaactggggaagggagcagaagccatgaaaagggatcccccgggggcctctgagtagatcaccaacatcatctgctgcatccagccaaaacaaaactaaccaccaccaaatgcttcaccaggtgtttttatcttgctgtcttggattcttagggctgccataacaaattactacaaactacacagcttaaaacaatacaaatttactctttcacagttttggagactagaagtttgaaatcaaggtgttgacaggccacactccctcggaagcctctcagggaggatccttttttgcctcttcctgcttctggtagccccaggcattcccattttccctctgtgtctgtgtctctctgtacaaatccccctcttcttatagggacaccagacatattaaatttaggcccactctaatccagtatgaactcatcttaactaattacatctggaaagactctatttccacataaggtcacattctgagtttctgggtgggagtgaattttgaagaacactattcaaccaagtacacctgccatagaaaaaatgtactgcatgcagtggaagtcatcctattatagtaaatttgagggactcagagagatgacccttacaacagataattctcctcttttattcagcgtgaactgaaataagggtcagatccgatatgtgcttaaagcggcttttattcactttatgggaagggtgagtacactctctatacaaagctagtttgaagaaaggctctgtattaatgcaaactcttattgcatttggttcccacagatgaaacatacattaacaataattgctccctgctatgaagatcttttggaaggctttattctgttgaagaaatatatggtttaaacattttattgcatgccaaagatgttttattaacatcaaaggaaaaaattctaatattacagagtaattgcagtattgttcttaaggagaaactcatttaaatgataaagagtactaaaacctggttaaaccttggtgggagtaagagttttgcaaagtcttctggaaagtctgatagtgcaaaagtcattccatcaatttgtaagtcttcagttgttagtagacctgtttcctttaaagataaagctaggagatttattgtaaattttagaaacactgaaacgtttccaaggccatgattaatctatttccccattctttaaccaagaataacttacatgttcaagaaaaaataattttgtccatgattgtaaaattgctccataaactatcaatagtaatgattttaacattgttctaagtgaatacttagagtgaactgggtgtgttaatcaccttctttgtctggttttaaaatttatgtaaaggctagtgagtgatttagtattgaaagctgagatgtgagtaaagaattcctctctgtattctaagtcatgcctcagtgcatgcaaggttgggtgattttctaatttccagacctctctgttggttctctaagtacttattgattccttttctaagaattattgtacttagggagtataaaacctactctccaaagggaaggctaaattttcagggtaggaggcacctgggggaatatccaagtctcttcatttatgtttaccagtatggctgttcacaacattagttgctaaattagctagcctttattaattactttccccaaatctctataaacaaggctccagaattcatggctatatgagggtggtaaagctgctaaaatgtctgcaggcatcttcatcaacatctgagtagtttcttctttcaagaatgctttaatagaagaagaaactatggtagacaatcatgtgcaaataaacacaatttcacaaataaacctagacatgcctgtcacaggttgggtttcttgggaagcagactcagagtttagtgtgcaggacaggcaggatgcttattagcatgtgcccttgaaatcaacaactgtggaaaggaagggaaggaagcaggagtaagagggagaagctgagttgcgatgcagacccaacaacagccttggctgatcttatggaaagttctggatctgagatgtccattcatctgtctggagttgggcagaggagggtcaggttttcataccctcctgtcaatcagccattgaatgtgggttgccccaaaagggtgtgtgaccttgggtgcggctgctctctgcagcagaggcagtgcccaaagggggctgacagctgaaagccgtcttctggcagcactcccagcagctgggggaataagtcctttattcatgattattcctggagggggatctcgggagcataccacagcgttcaccacaatgcttcagtgaaaagtgataaaaatcaactcataatcaatgctaagaacttgggaaaatgagaaggatagaggaaggtgaggataattacagtgtttgaactgacaagacttccatatggagggtcttggaggtgaggctgggctagagttttgaggagctgacacattgtgatgaagaagcccaggaggggacaagagaggaggtgttcaagggtgaaaggctgtgatggcagaaaagggcaagatgtgtacagggatgacaataagattggctttcctgcagcaagatgttgagaagaattaaaagagacagaagcagaggatggaggtggggagccttgatgctcttaatcagctttgacttaagaaacaagtagtaaacatcagaggcttcagagaaaacagttcttgctgctgtgtacagaataggttggagagtgagggtagaggcagggaggctgcctgtgggaatctgggataccttggggagctttagctgttcccatgatgtctcctcacccagagtaggaactaggctgagcaagcgaggcacctagggtgcagaatttgtgcatgcatgaccctgagaatgtgtgtttctttacattttttctagcgcctccttaaatgttttgccctaggcacctcgcttgcctctccagagtctgactctgccctcaccaaaccatcccggacaaatatataatcttagcaaaaacaatgtatttgttctgtcaatgcctttcaaaacaagcaccctgccctcaaaaggcttgctggggaatgcaaaagaatgagaggtgtgtaatgggggagggggagctgttagtatttagctgggatggtcagggaaggtttttctgaggaggggacatttcaactgagacctgaaaaagttatccacatggaatgggtggaagaaagaatttcagacaagaaaggatagcatgtgcaaagatagacaaacatgcattcatttgcacacttctgaatataatcctcttaagccattatggaaaccggaagaggtgcttccaagagttagaaagcaccatgccttatgtttgcctttatgattaaagaagtcggagatagtgaaagctggggcaattggttgtctctttaaattccaaaaggcactattgagttttggaattctagatgtaaaaatcatattctactgaacatggtgggaccacatcttgaaaaagggaaggagacgcgatattgaaaagaaaataatatatatttaagaaaacatgtataataaaattacctaaataagatttaaattcttcctcctttagggttatgagccggatgctagtgtaaccaagttggcagagcagtatgccaaagaggtatgctctttacatgtaaagctattattgccttttactgtcccatgaagttatttaaccagcgtgtttatgtatgctagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaaggtacaaattgatgcctctctgaaggttcattaattccattcatgaaggccagaaccatctaatcacttattcactttagggggagcagactgtcctttcattccctataaaaggactcactgactgtatcccctagggacttctctccttccaaagattagctgtgtcctttggaaaggcatttttgtgctggatgaaggaatttgaaacccactgagaagagaggagcaggcttttccctctcacaagaatcgaggcattgcagtgttttactctttgtgtgtttagagaaattaggttacttctgatgcatgcagtttcttatgatttctcccctaagaaaagccccttaactatgctcctcaggctagtccttgcctctattttccaaggacctctaaatccagtttagttttgctaatgccctccagggcattcccaggggactcatctgtttggctgtcttccagtaagatctggaacaatgcttctcagtcttgagcaggtattagcatcaccagaggagttgttaatacacagctggctgggtcccacccccagggtttctgattcagtaggtcagggtgaaacctgagaatctgcatttctaccaagttcccaggtgatgcagtgctgctgcctccagggccacactttgagaagcaatgttctggaggaataccctgaaagccaaatgcacaggggttttgtcagcaaagcaacaaatctactttggtggagaaagggattaagcaagtacaattaatattatattgataaagtaatacataaatacaagttctttattgttatatataaaatagaacagaagtttgaaaaataaaaagtaaaaatgtctttctcccatctctttaacagagactattcctagaggtagcctctgtttaataatttgatgtgtctctttgcagaccttttctgtgcatttacatatgtatgcctcaatacacacataactattgatttttttgtaaatgatattttagacattacttatttatttattattattcttactttttccacttaacaaatcttagattttcttgctcactcatttagatattttttattctttttagttgctgcatagaattccaaaggataagtggaaccataatttacttaaaatgtttcctattgataaattaggctatttctgagaatgccgattacaaaaatgctgcaatgaacttgcttatccatatttctttgtgcaaatattactggagaataagatcctgaggagaggaattttggggtgaagtggtataaattttttaaaatatgagagtgctgctaaattgcttacccaaagaagattaaaaatgtatactgctgcagctgtatattatagttatttttccatatcctctccatgtttagcttttatttacatttttaatttttctaaatctggaggaaaaatggcacctcatctttgttaaaatttgcaattccttgattactaatgaagttaagcatctttttatgtttattgggcattgcccttttttctataaattgctattacattttttgcccattttctatttttttgccttttctattattggttataggagctctttatatattatggctaatcccttatcatgtggaatatattttcatggagatattttaaattatataaattgcttcatacttacacttgcttggccaatcttatatgtgttgctggtgctggaactgtaggattgaagaacagtcattttgttgatgtatggcatttataaatgttacttttttccatgtaattttgctggtattttagaaactcaaaatgtcctgaacctagagcttgggtgggaggtaaaacaaaattgtagtacaaaggcagtaattttgaggtaagaaagtatgaaggaatgtagttttgaatctgtatgtgaacaatagaaatatatagggaaatgtaactttcagcaattaactgttggagaaaattaaaactgctagtacatttgcattaagaatgaaaaatctaatgcatagtgcttataatcctgtttaattcacccctacctcattacctttatctaaattgttttaactagtgatggagtatgcttcaagtgctaaaaataataatttggagatcagctccaaatataatattatcacaccaaagcaactttttaaatatagtggactataattggtgacttttgctatcagccacatattacattagtagagttctttactgaaaggtctactgttccactaaatagaataacagaaaactgagttactggtgtaacttgaagtggtactctcttaaatttaaaaagaaaaaaaaaaaaaaaagacttgccagacacggtggctcatgcctgtaatcccagcactttgagaggcgaggcgggcggatcatttgaggtcaggagtttaaaaccagcctggccaatatggtgaaatcccgtctctactaaaaatacaaaaattcactgggcatggtggcacatgcctgtagtcccagctactcaggaagctgaggcaggagaattgcttgagctctggaggcggaggttgcagtcagccgagattttgccactgcactccagcctgggtgacagagcgagactctgtctcaaaaaaaaaaaaaaatttgaaagtaccatgtacatttctcctaggtgtcttgagataaaaccatcactctgctcctttgtctctccctttgcattgatgtctgactactggccatgtgtgtttttagatactgaagaaaacaaatatgactgccacatataatagtcaaaaagtggtcttatccccatctctttagactgctaaagttgctgcctctgactggacatttttacactgcttgcccagaaagccagaagaagtggatgatgaagtcttttattctcctcgatcactagtgttcccagaggcagaaaacagaaagtggacaatcatggtaagcaagaaacaaggaatggaggataagttctttgtgtggttccaacttggtcattcatgcctttggggaaataataagcaagtgagattatccaactacattacttgctcatgtaacatctatttttttccagaaactttataatacatcattagtgcttattagcatttatagtgtatttgcatggagtgagattaatctcctttcaaataaatccattttaaccaaaattcttaccacccttgatccgcctgagcaccagccaccagtttgccaaccattataagtcatataattcttattttagaatctctttgttcatgtttagagaagcccctaattcagttcctgtataaaatgggcattcaaaacatcttactttttcccttctctttttcctcattccatgccttactttatgactggactagatacttgttttcgttctttgagtttggccatagggatatatgtgtttttaggtatagaacatttccaaatttcatggcaaaacttatcttaaaaattaatggttcctttcagataaagccactagtttcatcttcatcactgtcattctaggaaatattaaccatatgtctactttacaatatcccaaatgtcacctgctctggaaaatagtactgacatgtctaacttagctccaccatttttttagcttttagtgacttaactggtctcaattactgtatcagccaggatcttacttgcaaacgggagtccactctaggtagataaatggaaagtaatgtattaagagacattaagcggctcccagaatcttttgggaaaggaagtgcagtgaataattcttggacaccatatagccagggacaacacaggcagaaaaattgcccaatgacactgtggttcttttgtagccagaacaccactgacacagcctggtacctgaggctcttgaaaccagatgtcagatactccattatagccaccacagctgaaatagatttctctacctgcatatgtagcagaagatccaatctctccgaagacggcttccactgcatgttgtttgcttctgcacccaagtctggagtagatgcagctgagtgggatgcctgtaccctagctgcaagggagtttgggaaaggcagtttttagctttcagcctctggagtagagaaaagcaagctggaaaggactagcttctaattatttatctaatctataaattggaataggtttattgtgaacattaaagtaatatgtgtaaagcttttagtatagtacataacacataacacatggtaaatattgttatcataattattaccctcattatcatcatcttcactattgatctgatacagaccctataaaataagcaggggttcaagctcaactatggctgcttggcagccaaccgtgactcccttttcaatagaagtttgtatattaggcctaaatttgtcatatctaataacagggatgattttttttcactgcatctttccagcttgccacctcaggacactaactttggccaaaatgtcaattgccttgttatctaggccagtacttctgaagccttaatgtgcatttaaattacctagggggtcttgttaaggtgcagatttgaattctgtaggtctaagatggagcttgagatttggcacatctattttttttttttgtttttttttgagatagagtctcgctctgttgcccaggctggagtgcagtggtgtgatctcggctcactgcaacctctgcctcccgggttcaagcaattttgctacctcagcctcacaagtagctgggattacaggcaggtgacaccatgcatagctaatttttgtatttttagtggcgggtaggggggtttcatcatgttgcccaggctggtctcgaactcctgacctcaaatgatccacccacctcagcctcgaaaagcactgggattacaggcgtgagccaccgtgccaggccggcacttctaataaggacccagttattgcaggtgccaccatcctgcagaccacattttgagtagcaaagatctagatgacaaagaaaatgtgagctctccaaccacatacctcaggaagagacacagcaaaacattttccttgagctctgtttttcatcagaagacaattgaagttacaaagatatatcaagtaaatccatcaaagtagatcctttgtagaaattcagtagggaaaactaaaaggaaactttccaaaacatcaattatggagatgctctgaacttcttatcttttaaagagcttattaaacaacgtctttaaaaccaatttacttgaaaaattaaatacgtaatgtattcacatggttgaaatatttatggtgaaatcttacatccacccatttttccatccatctagatcttaccgccatctccccattccccatacccctgagttacccactattattagaggaaaatattttaaagaaaccaagagacagaatcgtgttaaaatgaaagtagagagtctaaagtagaaagaatgctcacctgggagtgatgagacttgacttctgtaactggccttaatactagtcagctgtgccatcttagcgtctaagtattaactctctaggtcccagtgtcctctcccatgaaataagcagattgagccatagagatggcaaatgagttttaattcttagatccctaatctcatcaacaggctacaggaattctgttgagaaggattttgagcctgcctatggtgtgagacagaaagagtggcataactgattagcgtgccttacacggacgctagaaaggaggtggtgatacatgtgttgcgctctttatgtctctgagctagatgatttggaggtccctttgagttcagttcatttcagcagccatatagtgagcatctactctatgccaggtcctctgccaggcattggagattgaaaaaaagagaatagtatgcagccaccacacagcctgtacagttcatagaagcataacattttcaagtgggatgagaccttagagactatccacgctaaattcctattctataggcaaataaattattattattattttattattatttttattttttgagacagagtctcgctctgtcacccaggttggagtacaatggcacgatctcggctcactgcaacctccgcctcctgggttcaagtgattctcctgcctcagcctcccaagtagctgggattacaggtgcccgccactgtgcccggctaatttttgtatttttagtagaggcagggcttcaccatattggccaggctggtctcgaactcctgacctcaggagatccacctgcctcggcctcccaaagtgctgggattataggtgtgagccaccacagccggccgcaaataaattattcttatacagcttatttagaatggcctttaggttcagcactgccgtgatacatttttctaagatgttctaatacttgtcttcctccagactaccctatccaatacagtagccagtaggcacatatggctttttaaatttaaatctaagctaattaaaattttacaaaattgaagattcaggccaggcgcactggctcatgcctataatcccagcactttgggaggctgagacagggggattacttgaggtcaggagtttgagaccagcctggccaacatggtaaaactctgtctctactaaaaatacaaaaatattagcctggcatggtggcgcacatctgtaatcccagctactcaggaggctgaggcaggagaattgcttgaacctgggaggcagaggttgcagtgagccaagatcgtgccactgcactccagcctgggcgacagagcaagactccgtctcaaaacaaacaaacaagcaaacaaacaaaaaaagagaagattcagttcctcagttatactaaccaagttgttgaatgctcaatagccacatgtggctggtggctacactattggtattggacagcacagacatcgaacacttccatcactgccgagagctctattggacagcactactctagggaataatttccacgcatgcaacttgatttaaaatgaggatgaaataagaaaggaaagccacaatgtcgccctccagttctgagatgcctgtaatgactgatgtaaggtatacactaaaataggatgaagggctttttctttaatggtgtagcattttttaaagcagaagtgtcctctttcagcactcagagtagctttttaaggcctccatgctaagagatttccagtagtgctgttcagaacgcttcactaatcgcatcattctcttcatagtgcacaggtctttggacccctttgtttagaaacaaaaatcacacttttcctccccatgaagcttgcttttgtatttttcagtgattaataaggcagtaggactcacaaaaagtagatagatgttttccctctgcctataaattttacactggagctaaaataacctaaagggaccctgaaaaaaagaaaaaatgctgacacttcaaagcactgttatccacatatgactcttaagtccaaaacaccattgcaaatgtaattcacaatattttatagtcatttacttctccccaagttagagttgccagataaaatagaggacacccagttaaatttgaattttggataaacaatgaataatttttagtctaagtatgtctcatgtactatttagaacatacagtaaaatatatatttgttgttatctgaaattcttatttaactgtttgtccgtgtttatttaactgaatctgacaatcctaatccaagttgaatttgtaagtttttatttggaaataaggttgacacaatccatagacaattaaaaacaaagcaaaaatgagaggggctcccaggaacccattaagaagtttacagtgtcttttacctggtagacattcttatgccaaagtttgccctggctaaactagttccttcttgtcattcagacatcaccttaaatgttactgttgagcaagatcttcccacaccacccactcttaagtggttcccaaggctcctttatctcctttttacattttattttctaatggcactacttgatatttttatatttttttgtctgtttgttgcctgtccccctactataatgaaaacttctttatgaaggcagtaaacctgtctgtaacgttctttattatacctagaagtttgcctgacacatactttaaatatggactcaatacatttttgcagcctaaaggcaatatagggaattggttttagaacataagttttggaaatcaggttaaaattctggctctctctgtgatcttgggctcctaatcaacttaggcaagtaccttaacttcactaagaccagtttattcatatgaaaaatgaggataaaaaatagaaccaacctcttaaggttatgaggattcaatgagatcagagtcatgtgagcattgtagtcaggacccagggacaggtaggtgcagatccacctctcaccatcaccactcaggaaacttcctacatctcagtttctcgatctgtattttacatctcttaccatctcatacagtaggaaaggatattaaatggtatgatgtacatacagcactcagcaccgggcctggcatgtgataactttgataagtatattcagttaacacttttgaaatataagacctgcacttttgatataggctaggaacacatgtacagtgtggttgaagtgtaagaacaaggacctgagagaccacaaaactaccttttaagagtagagtcatccagattcacccatgttgtcacaaatgacaggatttccttttttaaggctgaatactattccattggatatatacaccacattttctctatccattcatccattgatggacacttaggttgattccatatcttagctattgtaaataatgctgcagtgaacatggaagtgcagatatccctgcaccagattggtttcagttcctttggatacatactaggaaatgggactgctggatcatatgggagttctagttttagttttttgaggaatctctatatcattttttataaaggctgtactaatttagattcccaccaacaatgcacaggagatccccccctctctgcattcctgtcaacacttatctttcatttttttaaaaataaaagccactctaataggtgtgtggtgatatctcattgtggtttaatttgcattgccctaatgattaatgatactcagcattttttcatgaacttgatgatttgtatgtcttctttggaaaaatgcctgttcaggtcctttgcccattttttaatcaggttgttttctttctctttagttgtttgagttccttatatattttggatattaatcccttaacagatgtatggtttacaaatattttgtcccattctgtggattgtctcttcactttattaattgtttcttttgctgtgcagaagctttgatgcaatttgatttgtctatgtttgtttctatcacttgtgttttcagggtcatatgtgaacaattacaagactcatgtcatagagcttgatatggtttggctgtgtccccacccaaatctcatattggattgtagctcccataattcccacatgttgtgggagggactggtgggagataattgaatcacaggggcagtttcccccatactgttcttatggtactgaataagtctcacgagatctgatggttttataagggaaaagccctgttgcttggttctcattctctctcttgcctgccaccatgtgaggcatgccttttgccttgtgcaatgattgtgaggcctccctagccattggaactgtgagtccattaaacctctttttctttataaatttcccagtctcgggtatgtctttatcagcagcgtgaaaaaggactaagacagagctttttccctatgttttcttttagtagtgttacagcttcagagcttatatttaagtctttaatccattttgagttgatttttatatggtgtgagacaagggtccaattttatttttctgcatgtggatatccagttttctcaacaccatttgctgaagagactgtcctttccccattatgtgttcttggcacctctgtcaaaaagcaattgaccataaatgcatgggttcatttctgggctttccttactgttttgttggttaatgtgtctgtttttatgacagtaccgtgtggtttttattaaaatgtctttataatatgttttaaaatcaaggagtgtgatgctgccagctttcttccttttgttcaagattgctttatctatgtgggttctttgtggttccctacaaacttaaggattgtatttttgatttatgtgaaaaatgacattggaattttgataggggttgcattgaatctgtagatcactttgggtggtgtggacatttttacattaattctttcaatccatgaacatgggatatcattccatttatttgtgtcttctttattttctttcatcagtgttttatagttttcagtaaacaggtcttttaccttcttgatacaatttatacctaagtaattttttgttgctgttgcaaatgtgattattttcttaattttcttttcagatagttcattattagtatattagaaatgttactgatttatgtatgtcgatttcattttctgcaattttactgaattcccttaccagttctaacagttttttggtggacattatgctaagtaaaataacccaggcacagaaagacaaatactacatgatctcacttatatgtggactctaaaaaagttgaactcatagaagtagagagtagaatgatgattaccagaggatgggggatgggaaggaaggcaatggggagttgttgatcaaagggtacaaagtttcaggtagacagggagaataggttttgagatctattatacagcagaatgattatagtcaataataatatatatctcaaaataacttagagaagaaatgtcaaatgtctctccataaaaaagataggtaagtaaggtgatggatatgttcattagcttgatttaatcattgcacattgtatacatatatcaaaacatcatgctgtactccataaatgtatacaattataatttatcaatcaaaaataataatttttaaaaagagtagagtcagagaaaaccagggttccaacccagttctgcactatctgtcatctcaaggattgatttcctcaactataaatgataataataaaagctaccttagaattttgttgtattaaatgagataatgcatgaacattttcctctagctcaccaaagctcctggcacagtgcttgaaaaatatttcttgaccaatacatgatatggtacttagtattctatctaatacctagtaagcactcagttaacattcaccatagtttctgatattattattgtcattcttgtggagattgagaaaagtaaaagtgaaaattaccatttgtgattgacagatcaaggggaagcggtatactcttggctatagagataatactctttcaggaatacccagcttcagagagcagacattgctcagattactctacatctgattcatcctaaacttctctaggctgcgagagatcaaaccacggtataaacacaaggatctggaataggagagatgatatttctctaaaactagccaatactatacttatgactggaaaattcagtcgtggctaccactgtagcatctcatttcaactctgtgacccactagtcctggaatgaggcctaattatgcagtgtttgtgtgtctagatcagtctgatctctgttgactttcatttataccctcctccaataaataaataaatattagttcagaactgttctcttaccattttcttgagaaaacacattttaactgtaaccctgcaaagctgaaacctaattcaccttctctaggtccctaagcagactgtcgctaatgtttatccatttctttctttctttgttgtgtcatcaggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttcaacataaaatactgtgttcataatgtataatgtctaagccattaagtgtaatctatgcttattacctaaataaattatcacccatgctaatttataagtaaacatttaccaggcagtcagctactggtaaatctgtgggctgtgttcctgtcccccaggaccaactagaaagccaaatgattcatcttgcagatgtggtacaattttcaggccaatgaggtagacaggcattcatttatggaggcaaataacgaaattcttaaaatatagctattactgtgcccaaactccaaagttttttccaataacttgtgagaatgtggtagtggggaatcctccaagagcatgtatctcttctctgtaatgagtacttactgttacaagccataagaagcttttgttagcaagtggtaaaagcatggatacctagagtagcattttcttaggttcaaattctccaacaagaataatttaatttttttcacatctgtgcttatcatgcatctactcacaccatatgctgaatatttccataaatctactacttgcaacattttagccaatctttttcctctaatttttctttggggtaataaaaatttacattattgaattattataatgtaattacaactagatttctcttgcgggtgactaacatttgtattgttgaattattatgatataatttgaattttttagttaaaatgttaaataacataagtgaagtttttttaaaaaattatacattttacagaagacaaaataatgtaatttcctttacattctacatttactattagaaaaatgtttccaggctggttgactgatattcttcagcacacagctctgacttaaatgagtaagcaagggatgaattacaaattagatttgcaatgaaggtgcaataaaacattttttgtgggggaaagaggctcataatgttacagaaaaaaacatcaaattttccagtaaatgtcaaaggtgacttttgtgtccatagtaatttattggaagcacttagaaagagagtggagtttagtggaatatctttcagcagagagtagaacaaggtgtcatatggattgtggaaggctcaccctcaaattgcctacatagaaagaagtgttcttccacttgccaaatggtctgccatagtaacgagctcccatctcattcctggttattctttgaactaaatggatggtatagtcttcttccctcacttggaaagaacttgtaataattttcttgccaaaatatagtcattttttcctcaaaaagctctatagctttctttattgtgtacatacaatttaacctcattctcagcccaattctgtaggaatgtatttgctttcttaacttttcatcttaatcagacattatttatattgtcaggaaaaaagaaaataggggaggaaaattcacccttaacttttgcaaagctgttttcatctcctctttcttcttaccccttttcctatatagctattacaactccgaagtttaacgaaaattctagaaatgacgcttgcatctttggtgtacataataaatcctgtcacctaatataactagccaaagagctcttttcttccaggatttctccacaataacattgggagtagacaccacaagtgattacactgcaatgatttcaatgtcatcagtttttgtttttgttttcagtgataagtttccaggtactttagaaaagtaattcagtgtctgggctgggcatggtggctcatgcctgtaattctggcactttgggagcccgaggtgggcagatcacccgaggtcaggagttcaagaccaccctggccaacatggtgaaactccccgtctctactaaaaaagtaccaaaattagctgggtgtggtggtgggcacctgtaatcccagctactcgggaggctgaggtgggagaattgcttgaaccccagaggcgaaagctgcagtgagctgagatcacaccactgccctccagcctaggtgacagagcgagactccgtcaaaagaaaaaaaaaattaatgtcagatatttctcattttttcttttctttcttttttttttttttgaaacagggtctcactttgtcacccaggctggagtgcagtggtatgttctcagctcactgcagcctctgcctcccgagttcaaagaattctcctgcctcagcctcccgagtagctgggactacaggcccgcaccaccatgcccagctaatttttgtatttttagtagagacagggtttcaccatgttagccaagctggtctcaaactcctgagctcaagtgatccactcacctcgacctcccaaagtgcttgggattacaggcgtgggccaccataactggcctcaatatcagatatttctatctggatattgtgctaattacttgactttggtaatgtccctgggtagaaagatctccacagagaatcagcatggcaatgccattgtagatctcctatacaagtgaccctagaacctcagttaaaatgtcagaggccccttggtccagtgccaaagttccatagcaagtcttctcatgtgataaagatgagtgaggactgcatatgaaaaaagtattcagaacacattccttttgagcctttttgtcttggaagctctcatcgatgtcttacatggagatgattgaggcatatctgagacatggtaccgctcggcaattttgtagggttgatatcctttgacaaatataaaggacatattaaataacagaaaaccactcaagtcacaatgatcagactcctataaccaagaatgccacatactgccttgcaggttgtggtttgtgtaaaggtctcaggtgaaagaaatgaataaaggttgagacccagtctgcacttcagttaccaagtcttgtgtagccaggaggaaggaaaaccttttttgtatgttgtccatggagagggggcactttttagtatttcatatacccgaataggtgctttgctttaaaccatacaaaggatcagtgtctagtaggggagaccctgccatcaacaacttacatttcagtatcaccttgtacttgagggcaatgagacacatgcaatgcactgatagttttggtgtcttgcctcagtttctgctaggttccttaagatgccatagtgaaaatgatagtgtctgtccattttgtgtggcaaacacgtgacacgaatcattgaaacaagtatttgagaatcaaccctgtagttatttaatattttaaagaaattcttccctaataattattcagaaaaattaaaatcattcattgataaaagaatcatggtcagataaaatggaattgaattccctgacatgtgctaaaacatttcacagtcttattaatgcctcacttatgtccatgacagtagacttagtctctaatacacacttttgtgaaactcatccccagagaaaatgcaagcacgactgccttctggagcaaaatcattaggcaaatgaattttcaaactggaacagagttttaaaaaatccagtctatcccttcatttcacaagagaaaaaaaactaggaaataacaacagtgttcctagtatagaaatatattcaatagagagggataattcatgtgttaaatgcccctctgcaaatgatctgggatcctacacatatagctgcttgatttgatttacccataggctgaatggggaacgggaagctggctggtccagggatatggctctataaggccgagggatagagaggaaaattcacaccttaggcagaggtggacactgatatccagagatacaaacagaaacctaaaattacatccatgtagtagatgctggtgatgccccatccagatgcctttcacctgggttcgtccatcccccagctgctgacagggttgcgtgctgatgtctcacagctgcctctttctttgaagtgctgctctcagccaccaggaactactgttagcccaggatgtcagactctcaccctaacctggccactagtagcctacagtcaatgagtgactgatatagggatataaaaacttggctcccttccctccaggcaggaccaggtgtgtgggtgaaatttcagccccagaactccacgtgggtgggatcaggctgaaactagtaaccatttgagaccacgtccttgcttagcttccctccacacacccgccccacccctctctgacacctcaacctgattcccttctgctgagagtgtgtcctcaataaatcactggcacaagaatccccatctcaggctacgttttagggaataaaatctaagatgatccatgaataagattttttgtgggtctgtactgctcatccttcaggcgtcaaggaggagtagagagctaagaggctattagacaaatgtggaagagctcatgttcagcaagcaaaaacttttccagttaccaggatcaaccttttgtagaagacagcagaatattaaaaataacaaatactatttttctgtcacatactcaaattcaaaacaggaaatttattacctgcatggaataggaatgagaccaatttactttccccagagaagaggagatttaagttaactgccacaatatttctgattaatttctgtggcattttagtacccttatagattggcaaccccagtagctgttcagttggtctgctccttgccctagcttcctgaggctgtgttggcatactttagtgcaagagtgtccaatcttttggcttctctgggccacattggaagaattatcttgggccacacataaaatacactaatactaatggtaactgaggagctaacaataaaaaattgcaaaaaaatctcataatgttttaagaaagtttacgaatttgtgttgggctgcattcaaagctgtcctgggccgcatgcagcccatgggccacgggttggacaagcacaagcttgttttcgtggttctccaacttaagtgtgcatcagaatcccctggagggcttgataatacacagattactgggccccacctgcaaagtatctgatttagcagatttgaagtgaggcctaagaatctgtactttaacaagttcttggggatgctgatgctgctggtccagggaccacactgagatcactggtctgagacaattctgaaggcttatatgaagggttttcacccccatatctgtaaaataccactataaagtatgtgacacaacccagattgtctgactattgctctttctttggagtcactgaggcctgagtttcatccttcctctactgtgtaacagttatccaaccctgctcttctgatctgtaaaatgagagtaatgctcatctcatggagttgttgggagaattaaatgcagtgacatatataatagtatttggcttagagcaaatgctcaacaaatattagcccccttttattttttcaattgtttttaacactattttttctttagccctttgtaaaaatttatatcccatcatcagaaagatattgagtggaatatttggtataaaaaaagtacaaggaatgagcttgtcttctgaaattggcagagcccagcagctgacactttatttagtcatttctgtctaggagctggtttgtaaatatgcaactcaggggagtgacttggctcattgccaaatggaatcatggaggccaacaagtctgaaaatccaatcaaggtgactaaattctgcttagaaaggcatcacaggaatatatatttatgtgaaataaatcaggggcatttagtaattgctggacttgaggtctagctggcaaaagaggaaaaagattaggaaggactcatcaaggtttattatccatctttgtctgagaatagcactgctcaaaagaggaagttttcacactgttcttaaggcagcagttctcaaaagttttggactcagaaactctttatgctcttataaattatgaagatcttaaaaagcttttatttatgtgggatatatcggtataagccacactagaaagtaaaacagaaattttagaaatatttatttattgattcatttattataacaataataaacatattacaggttaacataaggaacatattttatgagaaataactacattttccacaacaaaattaagttaatcaatggagtggccaaccttgttttatatctcaccttacattatatgtttttggaaaaaatgactattttaatagtctttgcagctaattgtggatatcttttgttgttacactaaaactccacaactgattataactccttaaagattagttgcaatgtggaatctgaaaccatataaattaacttttctacaccgttacattcaatttcatgtctatcttgccctttgaatggaccttttactcacacatgattccacattgatcatttggaaaatattagttcactgagttatacagatcttccaaatattggcacatttcattatataaaatcagaaaatcatatttgttaatagcactgctgatctcattagaaaaatctttaagcattgagaagtagatacacattttacacaattctagttttctcttgaatgctcaaattttgtctttgacaagaaataatgccaactgctttccttaaagtgacagctacactttgttcattttcaagatgtctgccaaatatccaagtttcaatgaccattttgtcagttgcttttttcccaagtaaaactggtgtcccatgtaaaaggtggctagttaaagcacaattcaaagaattgcaaaagtgcttttcttcaagacaaccatcatacttcattatgccacagaaggacttaatgctcacctcccatttcatcacacagaatattaaaaagatgtgtcctcatgaaattcaatattaacaatttttactgtttcatcaaatacttttttttttttttgagacagagtctcgctctgtcacccaggctggagtgcagtggtgtgatctcagctcactgcagcctctgcctcccaggttcaagtgattctcatgccacagcctcccgagtagctgggattacaggcacccgccaccatgcccagctaatttttgtatttttagtagagacgaggtttcaccatgttggccagactggtcccgaactcctggcctcaagtgactggactgatttggcctcccaaagtgctgggattacaggcgtgagccactgcccctggccattgaagacattcttaagtgaacttggcttttttgttaagtgcctctgtgcgatagtgaagaacacaatgatttttggttctactgctttgatttgtgctaaggtgtcagcaatttttctcaccatttcttttgcatcatctgctgatgctgctgttccagggaacaccctttgtaaagcatggccctatactgccttcagagatctaagagaggccaagaaggcagaactctggcttccatttttggaacaaccatttttgattaaacaagaacaaacgtttttgattaaacaagaacaactgaccccattctgattttttttttttttttgagacggagtcttgctccgtctcccagacaggagtgcagtggtgtgattttggctcactacaatgtctgcctccctggttcaagtgattctcctgcctcagcctcctgagtagctgggattacaggtgcctgccgccacgcctggctaatttttgcatttttagtagagacagggttttgccatgttggccagactggtctcgaactcctgacctcaagtaatccacctgcttcagtctcccaaagtgctgggattacaagcgtgagccaccaggcccagctctcattctggttttatctgtaatatttattagcattccctcaaaaagattctggtagaaaataaaaagtttatgatttactattataaaacaagtcttgactgtactatgaatacaatttacattgaagtttttaaaaaaaattctatgcatacaaagctgtctatttttagagccccaagtgtgtgccaagcattgtgttaagttctggggatacagtaattgacaagaaagacatgatcactgccctcatggtgcttatagtttagtaggggagactgacaaccacatgtaaatagatattgtgataagagctgtgtgggaaacaaattggatgctataatagaaaataaagggatgaaaggaaggataaacatttggattggtagttctcaaacttttatgggtgtcagaattaactggagagctaataaagaatacaattgtcctggcttaatcaaagtaaggaaagcctgggcctctgtatttttaccaaatgattttccaaatttcaagtagtactgctttaaatatagttcccagagcaagcctctcaaagaaggtgaccttaaactgagtcctgactgatgagaataattgggaaaaacaggcttttcattggatttggatcagatttgtctgaggtgatgccagtgcttcagctgtagggctgagaagtttatttatatcttaattaacccctttctatttcttattacaaatacatttgatcacttaagtgaatgactagagggattcctataacaaacgtgttttatgagcaagagtggttacactagatattttgtatttactaaccatgtcatggaacatctctctgaaagacttatcccattaacaagggacagatcacatatccttacctttaaaacctttcactgcaattggctctttttctgacaatgtcgttttacatagtcactgaacgataaattctgagttctctgaaactctcttcgttgtcttgctgagaagttaacaaccagcatgacactttgaattaattctcaaagtgcttatgctaataagattgtctcccctcaaggcttttcattaaatataattgtaaaaattacatttctttaaggccagtaaaagaaatcaaggtatttaatttctgatttccacataattaagtgaataatggaggggaagaatatttcagctagagggaatagtacataggttggccctgagatgaaagagggcttgtcttcttcatgggactggaagaagagagtatagctacagtatggtgagcaagagagagaggagcacaagacacatctgaaaagttcagcagggatcagtccatattggcctttgaggctaagataagaagtttggtttttattttatgttcaatgggaagccactgacacaacgtatccatcaaaagtgttctgtgaagacaaccttgagtttgtacaacacatctgtttataaaataggtacctgggaggacaatcaatattggcagaactagctccaggattctgagctccattttaccggttcatgcttcactctatctcttcatttctccattgttaattgttgccttcctctgcttctctgtattcacctccctattagtctttcaatgcattccatcctcctagtctttttttctcctggaagaattggaacttgggatcccatcttaagtgcaggatgaccttgagaaggaaaagaaactttttgtctgacgaatgcaagccctcttcaattatcaggcccagagaggtgttaaaatgcaacagcagtgaaatctcactcccacttgagctaaataattacatcttgagggcacttgctatatgggctctagactaactgaagccaagtagctatgaaatgccatatgctagacaccataattcatagccatagtttagcaatgcataaccaacctctaaccaatcttgttccggtaaaccagtgagaattcctgtcaaacaactttgtatcagaaaactctttgtccccttttgcctttaaaaatcttgtaacaaaaaggcccaaatggagcattccccaaggcaacttggaagtgtgtcctgggctgcaatcctcaatctttgcccaaataaactctctatgttaattttgtctccttttctttttttagtttgattagcctgaaggatgagaatatcagctattccaatcctactggtcctcttagctggatgaccttggctgagtcctatagcctcagacttctcatctgtaaacagaggatagtaataatgactacttatagaaatgtatgtgcaagtccagggaaatatttagagtatggcctgctacatagcacgtgctcaaaaatgttagtgacatatctcgtatttcctattcaaactttccatttttactgttatctcacattttgggcactttctgttcaaggagtatatcatttattttcaaatttaccatatcaccttgcattctgttgccactctgtaaatatttgttctgttttatacaattatgaaatgccaaaagacctaagaggagtgagaaaatgccacctgcaagactgataaggaaccccttcaggtcagtggatggatgtaacttgatcattgaaggactggcaacatttggatgggcaaagaaaaagaagggcattccagttggcatgactgttagtaaatgtgtgagatgaggatgttgatggtcagtgagtagtccacatgatttgaagtggaggatttgtttgtggaagtctttagtatgttagcacgaaagtgaggagcaccttcattaataaggtactaagtttggaatttttcctgcaggcactggggaacattgaacattttgacattaaagagggatataatgaaagcagtgcttcctcaagattaatctggtggtgttgtgtagatttacttaggaaactagtctcctggctagtttgttccctgaacaagggcagtagtcatgaaaacggaagatttgagccaagagaaaactgtcaggacttggcagttgaatctaaaagtcaaagaaaagaataatcaatttgaacttgaaattatcgtggtaggctgcagtggctcatcctgtaatcccagcattttgggaggcctaggcgggaggattgcttgagagcaggagttcaagaccagcctgagcaacatagcaacaacaacaacaacaaaaagccagtagttgtggcatgtgcctgtagtcctagctactcaggagactaaggtggaaggatggcttgagcccaggaagttggagctgcagtgagccatggttgtgccactgcactccagcctatgtgacagagtgaggccccaggtctgaaaaaaaattatcatgagatgtataaaagcaggccacttggcctctttcccttaatagttctatctttaaagcagagttaataaaatataacatcttagcttcacagagatgagaagaacttaagcaagatacttactgtgaagtatcaatatgataatagatgcaagagttcctagccccttgcctagcataaggaaagcaattaataaatgtttgttcattttatttttgtacttttggaaatagaacgctcatagacaaatcaaggcagtttgatagggggagagtagctaagggaaagaaaggattaaagaagatactgaatctatacttcttgtcttcaaatttgatttacattctaagacatcaaacaaacctatttgctgctcatgagtctgagagtagaatgaagaagagtaactacttagttacgattatttatggcttccctctccttccccttttattaggaaaatctcagctgaaacttacggctataaacatctgttttgctgacccaacacaacccaagttctttgataattaaattatttaaatgccttgggaagaagttatacatgtttaagtaagagcagacagttatttacaataataaaatacacagcccattcttttctctggacctgaccccttctctggtctctgaagaggccatgtccctcctcataccacttcaattttggccatagatacaacttccagtttccaggaatcacttccagtgttttttttctgagggcctttgtagtgttaaagccataccccctcctttttttggttatttctataagctctcttccaaagaactgagaatactttaacatgtagtcaataaaatgaatccacatcacaactctgtgtatctagcaggataaaacaatcccaagctttctaagaggctctcagagtgatatagagtgatagtagctcagttagtctcacttaaaagtgggaaatccccaccagaattgctaaaatgtaaaggcattgcagttcctagtgtatgtaaggataagatatggaacagctaaaattctttttttttttttttttttttgaaacagagtctcgctctgttacccaggctggagtgcagtggcgctgatctctgctcactgcaagctccgcctcccaggttcacgccattctcccacctcagcctcccaagtagctgggaccacaatcgcctgccaccacacccggctaatttttttttgtatttttagtagagatggggtttcaccatgttagctaggatggtctcgatctcctgacctcatgatccgcccgcctcagcctcccaaaatgctgggattacaggcttgagccccgtgcctggccctaaaattcttataccttgctggtgggactataaactggtacaaccacattgtagaactatttagcagtatctagcaaagctaacatccatatgtcctatgacccagtaatttaacttgatctggttggtggttacataactgtttgtaaggatgtattgagctgttgccttagtatttgtgcagtggggagtatttaaattttatctcaattaaaattataagtaaataaataactgtatatttgtaaacattaagaaaggtaaggaaatccaaagcaaaggaaataaatgagttgcccaagatcatctttagtctggatttggaaatgtattctactgcatcgcttcaactgaactgcctatcaaagaggaattacatttttaaatcatcgtatttgattaaagaaattgggcaccttctttattagaatgagggtctgaaccttctgcaattggtagattcaccaaatttctgctctgccaaactacgagaaaagagaggggttcaagattgaaagaccaggggaaagatggggaaaggaggaaaacaagagattgaaaagacattgctacttctcactcctactgctaaagctatctctaacatgggataattttggctagtatctttatttgatacccatttgacaaattcagattatctacaattcatacagtactttacattatattaagagtatatggtccctttttataaatgaagaggctatatatctcctcaagaagttgtctttgtttattcttgctgctgtaacaaaatatcagagactgggtaatttgtaaataacagaaatttatttctcacagttctggaagcaggaagtccagtaacaaagtgccagcagattcagtgtctggtgaaggctttgtctctgctttcaagatggtgctttgttgctatgtactcacttggcagaaggcagaagggcaaaaggggatgaacgctgtgtaaagcctctttaaaaaggcattaatcccattcacaatgaagaagccctcatgacctaatgactgcctaaagtccccaccttctaaaaccatcactttggggtttaagttccaacacatgaattttggagggacacacacattcaaatcatagcagcaatttatagtgatttttgatgtgttgcatatccttcagataaaagctcacagaaatctattcttgctaagtgagatcaacaatgaactctgaaaacaggttttcttaaccacccatgagaggcaatgaatatacctgagtggatcaattaactgcataaaattatacacagcattttatgtgtatattagtatttttttctgtgatgggaatcagagctttttgggaagccatgaatatgcacctctcagatctactgccaagagcatattgactgatggctccagcactgtgaaatccattactgagttgatgccaaggccacacttcccacagcttgctccaagacaatgacgcaggactcctctgatggcaactctggctcaagggctccctgatagccttgctgaactccctcagaactgtacttcagtctaagatgcatccactcaaccttcctctcatccttccttcctcccttctctctgtccttcacccagggtcagatctgctttgagccttccctggttccctcccaattttccctcacaggcactgtccttaatacatctcttccatgactaatcccatgtggtatctacttcttggtggagctggactatacaagtggtaccaggagttgtcctggttaacaggtggggtttagttagtccctagcacaaagtggtagctctattgctaaagatttcgctggtagtgacctgggaaaatgtcccaatagaggagttcagtggtcagaatcatgcttggatacaacttttaaagtaaaccacagtgctgtatcttacatgcgctactgtagagaacgaagtccagcacctggtaggtctctttgggttctagaagcagcacattccacccctatgaatattcctctagcctgtatacaaggtggcatgcaaggctgctggctttgagtaggatcctgagcaggaatataatctgcagcagatccaggttatggtacaggcaatcttgccacttgggccatacaatccagcaaaccatatgatattacaggtgttagtggtggaaaaagataccatgtggagtttatggcaagctccagtgggagcaaaacaatgtaggtcctaggagtctggagcaaggacctgccatccacagcaaaaaacattatgccttttgaaaaacaggtcccggcatgttactgggccccaataaagacaaaacacttgaccatgggtgtcaagtggccatgcagccagaactactcattatgagttgggttctttctgacccacccaagtcataaagtcggatagacctaccatcaatccatcatactatggaaatggtacatctaggaaggagtccaagcaagactcaagaacacaagtaaattgcatgagcaggtagctcagacccccatgtcatccataaatgatgcaccagttctccttccctggtttgcacctgtagccatatgaaggagagttcatatataaatagctgaaggagaataaacctctttcttggtttacagatgagtctgctttttatgtgactgaaagctaaacatgaacgatggcttcattgcaaccacattcaggagtggccctgaaagacagtgagagggaaaatctactaatgggaagctgaagtggtacatctggtcatctactttctgtggaaggagaagtagcctgaaataataatatatacggattcacaggcagtggccaatggtctgtccacctagtcagaagcctagaaatgaagactagatcagagaccagggatgcttgggtaggggtatgtagatggacatatgggagtgggtacaaagtatgaagatctttgtatcacacataaatatccaccagaatatatctgccacacaagcagacaaaatgactcagccagttgatattagccagcctttctcatcatccagcccagaattggcaccatggcatctacatggaggggtcattttggcagagatgtaggccaacaacacggaatcccatttaccaagattgatctagttaatgctgcctctgaacatccaacctgtcaacaagagacccatactgagctcccagatatgacactatcccttggtcagttgtcaagtcaaaaacactgggcgccttccattctgcaagggccagcagtttgtcctcacagggatagataaccattctaggcataggtttgctgttccttcctgcagaatctcagccagcatcactatcgagggattatgaaagtcctgattcataagcatggaatcccatgccacataacatctgaccagaagactcatgttactgcaaaggaggggtgagaatgaccccatgataatgagattcactggtcatatcaggtaccacagtgtccagaggcagctggcctcaaccaatgctggaatggtctttgaaaggggtaactaaattgttgctttgaaagcaacactctgaaagaaggaggcatcatccttcaggacacagtgtatgtattaaatatgagacttttatctggtgctgtgttcgcagtaggaaaaaatacatagatccagaggacaaagggtggaagcatgagtggcctcacttaccattggaggactttgtgcttcctgtcccatcaactctgggttctgcagagttggtggttatgttcctcaaagagggcacattcttgccaagggatgtaggaagggtcccatggaactctaagctatggctgccaccaggacacttagaactacttgtgtccaggggccagaaggcaagaagaggggtcacaattatggcaataattgatgccaatcatcaggaggaagtagggctgtttttatacaatgggagcatggaggaatgtgtgtgtgttgcccagataatacacttttgtgcctccaggtactctcttgcccatttatgactttgaatgggcaagtgtggtgactgcaacttcagaagcgtatgattcccaagggctcagacatctcaggaaagaagatttggattaaaccatcagggaaagccagtaaaacctgcacaggtgacagttgaggaagaggcagccccaagacctgctgcagaacaggggttgtaattcgtcttattaaccttcgtttactaagttttttcctcagaaaaagaggttcatggaaaccatgaaggatctgctccctgaccttgtgtggcaaagtagatctgtgcagtgcaaggagactgtgccagccatgagaatgtccctctcagacccgactatcaggattataattgacctactgctgctctgaaatccgtcagctcattgaagccatgccccccaccagctgctctcagccgtgagtaagtgcggcagggacactagggcaggtgcctcaatgggagatgcaggactcctctgacctgcccctgtggcctgaggactccttatcagctttgccaaaagtttcttagacatgcattaaagtctaaggcacttccacctagcctaccttcatttcatctctcctccaccgggggtcagaatctccttctcagtctgatggcactcctagcctaccctaagaatcggatggcactcctaaccacctctctctcaccattttccgtcacaggtctttccctcaatgactctcttgcacagttaatcccatctcagaggacctggatcaacacagctttcatcagatattcaaaaggtttatgacctaaaaaaggttgtatacaacccatttgccagatgctgagtttgcattcctgccttagaaaaaccagaaacacgatatggagccattcttgacccagatcaatgctttctttcttgcagtatccttgatctaggtaagtaagattgtgctgaagcatctgagaaaataaatcaatgatggcagtaagtttaggccaaaaagcgatttatcttccctctggccaggcaggcaggtcacccttccaacagagtcagccttattatataaactaggaagactcagtggaatttcacaaaggcaattaagttggagaaatagtctgccttaaatttacttattaaaataatacattaacaatactaaatgtcctacctgaatcatccaagaatgcagtgctattagtcactccaagaacttgaagtgtaccacaaacacaaaggcatgagctttctctatcctgaaaaatgcagtgacaagggaagatgattgcaaaccatttctggagaaaattaaatacatacatttcaggttttagacagttaggctttttaaaaataaaatgtgtgcttcctaatcatccttgagcttttcccatgatattaatcgtgttctgccagcagggagagggacgatatctacctaatagatctgttgcccatggggaagtatttcagagcctggcaacttccccttctctgattagtgacaggactgattcagagtgctcctccttgacccatttattcatgggtatgccatcaagaatagttccaagctttctatttcatggcataataaaaaataaactcaagcaaaattcatactctgtcctctttctgtcccatttttgtcctggtaatatttcctgggtcttttcccctcaaaacatactgtatagaataaaaattttatttataaaaatgcattgtcccaaatccccccagttgtgagtccaacttaaagtagtgaagagtatgacatttcttgggtaatatgtgagcagaggagaagctggaggtgggggtctgggatataggtggagtgaagccttgttcaaagcgcaaaaagtcccaaatgatccttcttcaagagtaatgtctctgtggagcatgctggtgttcatggcaggatattaggatgaggagcctgctggaacatcagtagctgattgaagcttctcttcattcttgtctgtagctgttccaattgtcaaaatcatctagacattctctttgggacaaaaagttctgtgagtccatgccagttttgtaatttaatttatcaggagacccaattcaccaagtgactctagatcaagtatctaatctcttgcatctaaatttatctgtttgtaaaactgagattatattgattatctcttcctcatttcataggttcttataaaggggaaaatgcccaaattttaattgagtcaatattataagagccaaaaatagtgttaaaatctatgactcatgggattctttcagcattatccatgttggttttgcattcatcaaaaaaaaagtagctctgacagattttgaagatctagcttcaaacattgagtactttgagggaggaaaacgacaaggtaaaacgttgctagttaatgttactagtttaaaggcaacaatattactgttataaaaccatccctcacatagtgttatctttcaaaggagtacatttcacataactaaaattgaagttgacatcagcaacccatgcttgcatggatctaggcaaatcaggattccatgcaactcttgatcacacaccctgcttcaccattttcttctgattctccagcatagaagctctcaaacaagtctgtcatcagaagtccctccttgctgggcagaaaaagaaatagcaagaaaacagtccattttcgagggaatggggagggggaattgccagaaactttcatgtcaagaagtttgactccatcgcactataatctggctctcatctaccatattatatattaataaatctaaaaatatttcctaaattgttttgctactagcatatggagagtaatggttctcactggagacagaagcaagccatttgacatggaaataacaatagcttctgtctctagttggtcaaccgcagctccagcagtaattgagttggatgttttccaagtcttcattcacaaagaggtgttcataatgatgtctatgagagtactttttcctcttaaatttcacagagcacctttcaaaacaaaaatgatggtaaaaaattattttatatatatgtataattctgatacacacacatacatcttattatcaaatacaaagttttaataatggctgatacgcattaaataatttatttgaaattttgtaaatggcatatgccattccagacaggtaaattaggtttgggaaaaatatgttcatgtactttgagtgctatgagctagcttttgtattagagcacccattgtattctaccttgtattattgctctttgttaacaagttcatctccattagcttacaaaccttttgaatacaatggcagtatcttttatttctttgtattttctaaagcagtgaaatgtggttcatggggaggagctggtctgggaacagttggttgccagtttgcaacaagataagaacacacattaacagtaaatatttaagatcttttatagaaatgtactattaccatactgtctaagtgcatgatgagtatgctcgtctagtagaacaaggcataggccagattgagtgttgttgaactggctagaatgacttgcatgtggtgtgaactgtatacttgccctgggcagcagaaccatgtattggtctggcttgcaattaattaggaataaaaagaacaacaaaactggtgctttaatgcagatagtttgagaagcaccgctgtaaatcaggagttggcaaactatggcttgttagtcacatcttactggtcacctacctgttgttgtatataaagttttacgggaacacagtcatgcccattcatttattatatatgctgttttcacactacagaggcagagttgagtagctccaacagagactgtatggttctcaaagcctcaaatatttactatctggccctttacagaaaaggctttttgatccctgttctaaagcaactttttttgtttttttgcttgtttgtttgtttttgtttgttttgagacggagtctcgctcgtcacccaggctggagtgcagtggcgcaatcttggctcactgcaagctccgcctcccgggttcacgccattctcctgcctcagcctcccgagtagctgggactataggcgcccggcaccacgcccggctaattttttgtatttttagtagagacggggtttcaccgtgttagccaggatggtctcgatctcctgaactcgtgatccgcccgcctcggcctcccaaagtgctgggattacaggcatgagccacggcgcccggccagcagagtttttttaaaaaaactttatttgtctgtaattgacagtaagaaatgcattttacttagcaaacaagtagatacatacatatatctatctaaaagttttacaaaaaaaatttactcatactacgtgtgatgcactttgatatttctcttctattctgctttaattgtattaagaaataatattgaacacaacatagtaaatttatattacaaccaattagatttttacccataatttgaaaattattgctctagcacattgctttgcacataggaaacatttattgaataatttattaatatatattaatatcagagttatttaccttctatgtcacatagggtttactgatattcattattatccacaccttctaagttctctcttgtaccacaaggactgaaagcctggaaattatatttcccagattcttttgccatcatagttccagttagagtttgatatgagagacattgaaagtggaatgaaggaggagctattattccacaatggaaggcaatgggcatcagcagacaaagacaaaaagcatggggttttgccacacacttccaggcatctgccttagcattcctctcttcagtgctgcaggcagctgatatcattggtggtagcttccctgtaattcaacatatttggtgagatctagatcattcatcacattttgtcatggttatgtttgggatatttggggcttcctagtcaattccacttgagaagaagtgttcaaaaaaggaattaactagagaaagaaattaattccattttctaggcagtatatgggataatcaatgacttgaggaaagacccctccaactggtgaaaaatttgaggggagaattacagaaaggaagagttatagtcagtagtgtgctggtaaatgtttagcaactggctctcccagggggaaaaaatccatgatttacagggtttgactatttccatggtgtaaataatcccacaatggccaatatcaagctagcaatgtggaatcaatgaatgtgaagttggaaaggggtgcccacaatcagttctgcaggttagtgggagctggctacaacacattagatataatcttactagtggggtgtccagggcagccgcagcttgtatctgttgtccataccagccatctttcacttcccagagtattttatttaatagagtctattctttttatgcacagtagttatgttctataaattcactgcaaacaccaaattggtgaatactgaactatcactcctagggaaaacataaggtcaggttcctgcaaggctctggtaacatttttatcaaccaatcaatacattaccttgttttctgtgtgttcttgtttaaagacaccttatttaatgtatattgttggttcattatacattaacatatagttatagattatacactgagctcacggccaacagcactatctcacgcctgaaggagacttatctgacatatacattttctttttaagaaatattataggccgggttcggtggctcacacctgtaatcccagcactttgggaggccaaggcgggtggatcactaggtcaggatatcgagaccatcctggctaacatgttgaaaccccgtctctagtaaaaatacaaaaaaatagccgggtgtggtggtgggcgcctgtagtcctagctactcaggaggctgaggcagaagaatggtgtgaacccgggaggcggagcttgaagtgagcagagatcggcgccactgcactccagcctgggcggcagagcaagactccatctcaaaaaaaaaaaaaaaagaagaaaaaaagaaaaaaaaaagaaatattatagccttcttgtgtttatgagcaataggcagcacttcagcactatatataggggccactttaaacagcaaaatcattaagtaaaagcacaaaaatgaggaaaatgtggcactaaacagaccatgaaaagaacacttgtttacagtgtaagagctgaaacaaataggcagggtgtcaccttgttcaacctaagcaaggagaatgcatgttgagtgggtaaaattttttgtcactctgagcatgtctatgaacaatggcaaaagcaccacaagtatagattttggtgttatgaatacattttagcaagcaagcaaatctgtaaatacagtatccatgaataatgaaaattgactgtatattatgattaccctagttattttttaaagatttttattgatacataataactgtacatatttatggggtacatgtgatattttgatacatgcatacaatgcgtagtgatcaaatcagggtaattaagatatccatcacttcaaacatttatcatttctttgtgttggaacatttcgaatctccaactattttgaaatatatagtaaattactgttaactatagtcaccccactgtgctattgaacactagaacttattccttcttatctaactgtatttttatatccagtagtcaaccactcttcatcctcccttccccattacccttctcagcttctggcaaccatcattctactttctacttctatgagatcaacttttttagctcgcacatgggtgagaacacacaatattcatctttctgtgcctggcttattccacttaatataatgtattccagttccattcatgttgctgaaaatgacagaatttcattcttttttgaccaaataatattccattgtgtatatataccacattttaaaaataagttcaactcttatattggattcaggaggtacatgtgcaggtttgtgaactgaatatattgcatgatgctgaggtttgggatacaattgatcccatcacccgggtactgagcatagtacccaataggtagtttttcaacccctgctcccctcctacctcctccccagtagtcttcagtgtctattgtccacaaatacccattgttcatctcccacttataagcaagaacatgtggtatttggtgttctgttcctgtgttagctcacttagagtaatggcctccggctgcatccatgttgctgcaaaggaaatgactccgttgtatctgatagcttcattgtatttcatggtgtatatgaaccacattttctttatccaatccacgctgatgggttgattccatgtctttgctattgtggatagtggtgtgatgagcatatgagtgcattagtcttttggtaaaacgatgtatttcttttgcgtatatatccagccaatgtgattgctgggtcaaatggcaattctcttttatttttaagttctttgaaacatctccaaactgctttccacagtggctgaactaacatttccttgaacagcatataagcattcccttttctctgcaacctcgccagcatctgctattttttgactttttaataatagcggctctgattggtatgagatggtatcccactgtggttttgatttgcatttctctgatgattagtgatgctgataattttttcatatgtttgctggccatttgtatgtcttcttttgagaagtgtctggtcatgtcttttgtccatttttcagtggggttgttttttgcttgttcaattgtataatttccttatagattctggatattagacctttgtcagatgcagatgcacagtttgcaaatattttctcccactctgtaggttgtttactctgttgatagtttcttttgctgtgcacaagctctttagtttaattaggtcccacttttcaatttttgtttttgtcgcaattgctttttttttttctttttttgagacagtttcattcttgctgcccaggccggagtacaatggcacgatcttggctcactgcagcctccacctcccgggttcaagcgattctcctgcctcagcctcccaagtagctgggattacaggaatgcgctaccacacccggctaattttgtattttttctttagtagagacaggctttcaccatgttggtcaggctggtcttgaacacctgacctcaagtgatccacccacctcggcctcccaaaatgctgggattacaggccaccgcacccagcctgcaatggtttttaaggatgtggtcataaattctttcccaaggctgatatccagaaaggtatttgctaggttttgttctaggattattaaagtttgaagccttacacttaaatctttaattcttcttgagttaatttttgtatatggtaaaaggtagggggccagtttcattcttctgcatatgactagccagctatcccagcaccatttgttgaatatggaatcctttccccattgcttattgttgttgactttgtcaaagatcagttggctacagttgtatggctttatttctgggtcctctatgacattctattggtctatgtgtctgtttttgtaccagtaccatgctgttttggttactgaagacttgtagtatagtttgaagttgagtaatgagacaacttcagttttcttcttttccttagtactgctttggctattagagctcctttttggttccatatgaattttaggatagttttttttttttaatttctgtgagaaatgacatgggtagcttgaaaggaatatcattgaatccgtggactgctttaagcaatatggccattttaactacattgatccttgcaattcatgatcatggaatgtttttgcgtttgtttgtgttatctaggatttctttaccgatttggctctcagcttgaatcttattgaataccatactttatttattcaccctttgatggacacttaagttgattccatgtcttggctattatgaacagtgctgcaacaaacatgggagtgcagatatctctttgctaaattgacttcctttcttttggatatatacccaggagtcagatatgtgaatcatatggtagttctaagttttttgaggaaactccatactgttttccatagtgactgtactaattaacattcccaccaacagtgtaaaagcattaccttttctccacatcctcatcagcatctgttattgtttgtctttttggtaatagccatttaactgaagtaagataagatctcatggtggttttgatttgcatttttctgataatgagtgatatcaaacaatttttcatatgcttcttggccatttgtatgtcttcttttgagaaatgtctattcagatcatttgcccatttttaattggattatttttgttttctgtttttgctattgagttgtttgagtttcttacaaattctggttattaaccccttgcgaaatggatagcttgaaaatattttcttccattctgtaagttttctcttcagtctgttgatcgttttccatgctgtgcagaagctttttagtttgatgtaattccattagtctatttttgcttttgttatctgtgcttttatggtcttgccccaaaatctttactcagatcaatttccagaagtgtttctctaatgttttcttctagtagtttcatagtttcaggtcttacatttaagtcaatctattttaagttgattttttttttttttgagacagcgtcttgctctgtcacccaggctggagtgcagtggcatgatcatggctcactgcatcctacctcagcctcccaagtagctgggactacaagcacatgccaccatgcctggataacactttaattttgtgtgtgtttgtatgtagagacaggatctccctatattactcagggtggtctcaatctcctggactcaagtaatgcttccacctaggcctcctaaagtgctgtcattataggcatgagccaccgcacctgacttaagttgatttttgtatatgatgagaaacagaggtctagtttcattcttttgcatatggatatccagttttccctgcatcattttttgaagggactgttttttttttcccaaatataagtttttggtgcctttgcaggaaatgagttagctgtaaatacatggatttatttccgggttctctactctgttctattggtctatgtatctgtttttatgtcagtacaatgctgttttgattaccattgctttgtagtacatttttaagtcaaatggtgttatgccccagctttgttctttctgctaagaattgcttcagctattcacagtctcttgtggtttcatacagatttcaggatgttttttccatttatattaagaatgtcattggtattttgataggaattgcattggatctacagatcactttggatagtatggacattttaataatattaattctaccaatccatgagaatgggatatcttttttttctttgtttcctctttgacctctttcatcagtgttttgtagttttcattatagatatatttcacttctttggttaactttatttctaggtatttttttgtagctattataaatgggaatgctttcttgatttctttttcagatttttttgctgttggtatgtagaaatgctactgatatttgtatggcgattctgtatcctgctatgtcattgaattcaattatcagttttaacagggttttttttttttttggtagagtatttagttttcctaatataggattatgtcatctgtgaacaaggctaattttactttttcctttccaatttggatgccctttatttctttctcttgcctaattgctctggctaggacttccagttccatgttaagtaacagtggtaaaagcaccacccttgttttgtttcagatcttagaggaaagaccttcaatttttcctcattcaatatgatgttgactgtggatttgtcatatatggcctttagtgattttaggtatattccttctatacctagtttgttgagagttcaccctagttatcaagtgacaaaagtcattaggtttttttcatgggtagaaaggataggaactctgaaataattagttagagaggaagaaagatttaaaattttgccaagattttgttgaagataattttatgtttaaaatcaacttaaaggagctgcaaggggccagacagattgaatttgttacaagttttatccttttctggagttcctgaagctcagaattctaaccaaatcttgcatctcactgtgggtgttttagtgtgccagctggaaaatgggatgaacaaatagggtccctatggcctctatcctgaggactctgttggaattgatggcaacatcagcctgcttcttattggttttcaaagtgagggaagaattcaaaaatcctaaatgctgggagcatccttatgaagtctggtcttttggttgggtctattgaagattcagactggtactgaaaggatttatcgcttgcatgtcagatatgtttttcctatttatactcttcactcctctctaccatgctctttgccccaggagctgacttttatagattgcatcaacagaatactttgtcttctgattcctggctgtctaacggtagacacatgtagatcattgcatgggaatggagtgaagtcagagtatttattcccttggtttcttctcttctgagttgccacaggttggcagtggttgtatttctccaccaaaggccacaactcccattgcttggccttctcttatagctacagttgtctctctatgttccagtaattgctccctttacctcttcaagctctgggttagtggcatccttctccactacactttgtcttagccaaaaggtcgagaagcaataatggcatccttgtgggactcctagggtacctcattattccttgttggttttccttaaacacttccataccatgataagcagtctttttattaaactgtcctcaactgtcttatttggctgtgccatattgtttccttctgtgacctgactgatgacattgggttcaggtgttgtaagtctgtttcttccattataaaggtccccattgacatccacctaatgatgttaataggttttgatgattgctgctagaaatgccaagcaccaattatgtcattacctaaagtatagcttgtacaagaaatagaataaatgtttgattatgtctctttattgatttttcagaagagttgatgttctagtaacctccaaagaagcctcccttttttcaaataatattgtgaattcataaatatgtacatatctggtgtgcttcgttatttcttttgatgctcaaattgtcccatctttcaccagcagtagccccctcatgctgttgcctttttgtcatgacctcaataggcttcaatagcttccttgctctgtggaacaatgtgatgtctcagattctttttatatatttctgctccagacgtggaaccaaacattactctaaggagccctgattcctttttgtggcaaatgctatttagagaccataattgggacattagggattctagtttctacaggattttcattgcttctacattttttcagtgaagagaattacaaaatgtgtacatttttagaaagtgaaaagcaaatcatgagtttatactgttagttccaaggaaaaatttaagattactgggtttttaacttattttagatgtgtatcccttttctcttaaatggaaaatatcctaataatattaacatattaataactgatcatttgattttcctgctttatatgtcatagtctcaaaaataacaatattattattaaaaacaagactattgagtgtagtgtaagatttctttgaggttatttggtctttaggatatattcctcaaagaatttaagggggttaaaagggtttcatttaaaaatcacttgaaatagtacttctgtggttgtgccaccaaactgaactataattagatttcatcactacaatctaatttaattttggttttgtgtaaaaattattctatgattctgaagtcaaaattatagaataaggtacattcagagagtcctaacttccttcattgttcttgttcacatatccccacatatttccttccccctcctctaagtaatatttctttattaattttttccttccattgtttcttattgaagcaagtgtgtgtgtgtgtgtgtgtgtgtgtgtgtgtgtcccaagaccttttttgtgccaaaggtggcaagctatacgtattttacttcaccttgctttttttggttttaacagtatatcttggagattacctacaatggtataaagagatcgtcctcattcttttcaacataaactagtccttcattgattagatgtagcatagtttattcaaccagtctccttgagggtcgtttgggttatttccaagcttgtgctactacaaatagtggtgaagtgaagtttttggtatatgtcatcttgaatttttcctagacttctagaaatgaaattgctggtcaaaggataaatacatatgtaatttttttaatgttacaaattcttctccagaaacattgcacttccaatgagaatgcctgtttcctcacaacatcaccaatggagtatgttgtcaaaccttgagattcgttttgcccctgaatgggtgagaaatagtatctctgtgtagtttaaatttggatgtgtttatcttaccatgattaagtagagcatccttgcatgtgcttgaggttcatttgtatatctatttttatagacagtctgtctctttaagacagaagagatttaaatgctcttcaaattatgtaacatgaatgtcttagtttcagtgccccagaggctgaccgtaagacaaggattcatgtgatcatgaattattagcaggtatttccacgaaaaggcagtatactaaatgaaaaatgggacaagaaaaagaaggaggctaagccagggtgtgacagcaaacaaggttccagagaatattgctctgggtcaatctcataggggagttatggagaccatgtgaaacacatctcagaattgtcccctacaggtggcaaggggggtagaatatttttttcttttcactgtctgtcactgattggttaagggctgctctcaggggacacaggcccccaggcatttccagctctttatatcgctgggcaaatcaggcttcaactgcctgagagcagtcatccaactaagaaatgtagatattggaaatgaaagccttcagggagctagaaagcatgaacatggcgaagagattgaagaggttatgggtagagcactggcggcaactactttaatgagtgactacccattccacactcacaggaggtcagcaccgtacaaaagagacatgtatcagggatgatttcaatataaatatccatgtccatgatagatgagacaatattattggcatcttatgtacttgatctgactttataacgatttgctaatcacatgtgttaaaagaaaattatgatgtattatgtacacccagttttccctagtcacacagtgttgagtcaaatgtctcctttgagggtaccttagaattttcactgatgcatagggtaatccctttgtgtgaaatcaacacccagacctatgttggaattaaaccagagttcccctgacactagcaagaggaataaacagagctttgttttctcagctaatgagagcaaacagttctatcccaggtggccttccttggaggtttttcaactataagataatcacacacaggccagaggtacagctcaacaatcctgaatgagaaaccaggaaaggaatagaacagaataccttgcttgaaactatcaaatattttagccagtggcaagaagtttactgacaaagcaggttttatctcttaggcctttgaccctggttttcatgttttgatttataggaggacctaaagagctctcagatttcaacatcacagagagcagaaagctgttcctcatttcatttattttattattacttaaaattagtgagtggaaacaggctacaggagaagagctaacatgaatggaaattgaccaggatgtaatttctccacatccgtatttttttcctcctcaattctaaacttgaattttgatcaattctggggtgaccgtcttatctggatttgcctgggattttcccaattttagcactgaaagtttcagacatagggcacactggaatggttgtttagccattttgtgaataattctggttatattactggtttaggacggggcttctcatggtaaactgcattcaaattccacgaatttcctgttaacatgcagattctgattcaacagggctggggtggggcctgagagtctacatttctagttttcaggtgatattgatgcttctggtccatctgtggaccacacttgaagtagcaagggtcaacggtagggataatattgatcctaagttttgttgcacatttcaacatttgaaatttaattttagtttataactacctttttgtttttttttttttttttttgagacggagtctcactctgtcgcccaggctggggtgcagtggcatgatctcggctcactgcaacctccacctctcaggttcaagtgattctcctgcctcagcctcccgagtagctgggattacaggggtatgccatgactcccggctaatttttgcatttttagtagagacagggttttgccatgttgaccaggctggcctcgaactcttgagctcatgtgatccatccgcctcagcctcccaaagtgctgggattacaggcgtgagcccagctaaaattaacccagctaaaattagcccgaccctagtttattgaactttgaacttaaggaaagaaaagccttggcctcccaaagtgctgggattacaggcgtgagccaccatgcctggccctagtttattgaactttgaacgtaaggaaagaaaagtgtttatgtgataatcatatttctttatgactattcatggtgaaggaaagagaaattaatgtacttgccaatagagcatttatgtttatgaaaaagttaaaggaaaggtattcaacatacaaaaaattagcattttaattgatgcaaaaattgtagattgcagttgttgctatatgttttatattgtatcatttgtttagtttccttttttggattttgaacaaattttgaacttgatattttcttagataattttaattttattaacatgtctgcactgccaattgctagctcagtcacacacaggcaccatctgtaccttcaaatagaattgtatgttttttatccttattacaaggacatatttctatatatttcatatataagatatgaaagtacttaataagggttcttcctaaatttgttccctcaattccatatctgaaactttatttatttacttttctttgggcattcttcccagcagcaaatctcctttaaacaacacatttcattggtgtcatgagatagctttgattccaggaaagagcagggcttattgttactcacttccattgctactagtaacatgaaaagcgacatctaaatccatactatgtttttctaatgagtttttttagagttattttttgccaagtttctcaactacagggtgtccactgttaatcctatttgatcagtttctattttaggagaagactcatagaacacagcaaatatttcatttattgaacctctcacagttatgaactatcttcccaaatccaccaacttcattggatttctaaatctattaatggttagtaattgtgtttgtgtatgtgagatgcatgctgtattatatatacaaatatagatatatatacatgcatacatatacatacagttagttaaaaatacacattgctcttggctataatttttaaaaacccaaataagtttattttattttatttaaaaaatttatactctaccttgtacttctagtacatatagcttgtatggctgcatgtcatcctaaaaaatagaaagcattagatgaaagaaaattaaataaatcagaggataatgtgaagctaagagtaaacatagaagtagaaacaataataacattcgcatctagagtgtaagctttagaagtagatatgatagtgtctaggagataacagcagaccaactgatcaatatattgaataggagtatttcaatgtaatatttcatcttgttccactggcatcagtgccaagaacaaactagtatttgtccagtttggaaagaactgaaagaaaacttttcaaagcccaaagtttctctcccactctcttcccatacctttctttctttggaaagaaaatgaaactttttaatcaatgaaattgacatgtagtttatatacactaaaatgcacctattttaagtgtatattttgattagttttgacaaatgtataaacttgtgtaagcgttaacagttaagatgcaaaacatttcccaaacccctaagtacacccccattctagtcaatactccccacctctagccccaggaaaccactaatcttccttctgataccatggattcgatttatcttttctcaaatgtcatataaatggaatcacagggtgtatggtttttttcttgcccggattctttccttcagcataatggttttgagattcagatatgttatgtgtatcaaaagttcatttagttttttactagtgagtaatattccattgtgtggatataccacaatttgttcattcaccaattgatgggaaagtggttgtaagagaaggaaatttgggtaaaagatcatgtaaatctattagcttggctttatgaataacagaagatgtgaagagagtgagattcttgctaaaatattctttaactcagcaactaaatctctgtcttcttttctgtctctgggcctgttgcttcttttgttaattagtaataattttattatataaacttaaagtactttagatttagttaaattctcattggcaaatcaaagcatgccatatttatcatctttggctcaaatatcatccctgagtggcaggcagatggcagactgtgttatcctctatcagttgaaaaggaaacccctggaagtaagttaatattttgggctttagcagaaagctgggactgaaactaggaacacaacatacattttcaaagcccaaagtttctctcccactctcttcctatacctttattctgaaagagggggagtgaacagaatagccaaagtactgcctccttcccctcgtccccaccccaatttcctcttcccacttcaacccaagcagcaggtctttaacctattttatatattgagcttctaagtaaaatttcatttgctgaaatatttctcaggttaagaaaactattgaaaacccattgaaccaaatctcataggaaaattaggattatttgttttaaaacacaaacttcagtgatataataatgtctttcacttacatggcactttctacttctttaaagagctctcacagacatttcatttagccagaagaataaagctaatcaataaatgtaattaattaagactatacattcacaaatgtcttaagtccaattaacatttaattatccttgttaatgggaaatggactgagtttgtgtgtgcaagatccacacacaagctaaaaacttaattacagcaagtggtttctaacttctgtctcatttaactttggctggaggtactaaaaagtacccatagtggttaaaaaattttttaaggcaatgtatataggttgcatttcctatctcttctacaagagaaaggtggtgaagtaaaataagaatattgagaacatgcatcttttaaacacacaaaaaataactttccaaaaaatgactgctagaatttgatatgatggtgacacatagttttaaaagtgacttaaaagtcttccaatgggcaaatactaaaacatcaacaacagtatagcttacctttgggcaactattgagatcaagaagacaggcaagccatgtacctaagcatggcaacaactggtcccaagttgcctggacagttatagttaatttttgttctggcataattgttaatagctccttctttaactctcagaagtgtcctgatttggatgataaattatatggtcatcctggctataaggaaacagcactgaaccatgactaagatgaaaaaaatattactttttcccatttttccttcctcaaaatttgagcatctgctcaaactggctttttttgtttttgttttttgagacagagtttcattcttgttgcccaggctggagtgcagtggcgcaatcttggctcactgcaaactccgcctcccgggttcaagcgattctcctgcctcagcctactaagtagctgggatcacaggcgcacatcaccatgcccagctaatttttttattttttattttaggagagacagggtttcaccatgttggccaggctggtctcgaactcctgacctcagatgatctgcctgcctcggcctcccaatgtgctgggattacaggcgtgagccactgcacccggccccagactggcttctttcattatctaaactatagatataatgaggtttcctctcctttctactaatttcaatcagtggtttgaaaacgtgggcattaatcagaatcactgagaagcttaaaaataccaatgtctgagaagaatcttggaacagttaagtcagcgtctctggaggtgggacgtaatcattgctactgattaaaagattcccagataattctaatatgcagccagggttgagaatcattgattctgacagtcactaaataattatttctattacaaaatacctggtattgtgagtgatgtatgaagtttaagatctccttggggaaaaagaatgtccctgcccaccatacttgaccatggcatacctttggctccatcctctgggtagccaaaggggctgctcattcctgttatcttcggatcacacaaagagtaataattctattttttcttccaaaatcttcattgtctgcaacgataatacagcaaagccaaatgaagacctcctttggcctgggataaaggcactttaagtgacagtgatagaggcatttgaagggaccttcaagttggccactcattatctaatggaagctctgacattctgaaagcttaggcaattgaagctaggtggcagtcctgcttagcaattaaaggagacaccataaagagaactataaagattcacacagaagaaaaccaaaaatgacttgccactgatttaacaccaacataggatcaacagggcaaaactaacttgctgtgttgtgcctttagatacagtcttcctcattaaagctcaggaatttccttaaaattataggcaactcttaaagtctgatgcttctaaataggctccatgacctctttacattctagtttaccggaagttaaccctactcccttatgcaaatgtctgcaaatagacactggtgaatctttaatcttctataaaatgaaagaatatgaggaagttatggagaatattgagaagcatctgaaatggtaatgcttgtgatacacaaaaccatgacaaactgtgattcttttaaaatttgtctataaagatgtttaccaaaatattcacagtgttcacctccaggtcagatgatttgtggggatttttatgttctttctaatacttttctgttttatttaacttgttttacaaaaagcgtatgccatcttatttaaaaattttactgtttttatgagtgtcaaaatgctgtttaactcactgaagtccattagtgattagataattagcagatcatgactgttttctgtgatgtctattctcagcccaaggcttgctatactttaattgatgattcctctaattaacattgttaatggatgacgctagtgtgtgtgcatcccagacaatcaatagattgtgcttatacttgctctaatttgaaaagctcaccagaagtagatgtttttgtttatttgctgctgttttagggaatacccaagatgaagatagggtctgttgagttgcatagatttcatacattttaaagtgtttaacaaactatcccttagatagaattttagaaattataaaagaaattgctatatcagaactaagagctcagaaagatttaataattcttctaaacacatgttcattaaattatttgagttaagcacagtatattaaggagtgaagttaggaatacaactgacagtaacagttgagtatcccaatggttgagcaacttctctcaaaaataatgtgtgattagatattgagtgagatttttctgtttccctggaattaaagttaaggcctaaagctgataataaaagactaaatagtaccctaaatctaagtttagatagccatctagagttgaggccagctgctccactgcaaagaatatgaactggaaattaaaaaaaaaaaacagaccctacccttcccttctcttagtatatactatgggagaactcagggagagtccgtgactctatatctgtaaagtaagccgttgtgacccttcaccattaccatcaacctttctctgattgccctcggggtgagggtacttccctttgtcaaaaccaagatgggagtttcaagagaatcactcatgaagttatagcctgttagaaaaggagactggaatttcactctctcattggatgtctccttaggccagactacttgctggactgtccctggaggagggaaatgagaattgggaggacgtggcaaggtagatgactacgaaacagagagggtgccaggaacaaactccacttaaattcatgtttcctgagagggccataagacagggcccacattaacaaaaagaaagtgcaactgggagcctcggtcctgcagcaccgctgcagtatgggaagcaagaggctgagtcacagaggaatgtgttgtgatagcacgagctgggagatctaaagagataatctagaatgtagcccagagatgggagataaaatctattaaagaaaaggttaaaagacatggtggaacacaactattcaaagagataatggataagaattttcccgaattgttgacaggcccaaacctcattataaaattcttataaatcccaaacaggaaaaataagaaaaatccacatcttcatatatcttggtgaaactgtgaattaacaaagacagaaaatatccaaagcaaccagagaggaaaagactaacaaacacttataaaagtatgaatgtcagaccaatagccaccattgaagccagaaggcagtggaatatctttaatattctgagattaagtaactgtcaaattggaatttcatacccacggaaactatatttcaagaacaaaaatgaaaaaaactttttttagacaaagaaaaataaaaggcttttatcagtagatcatcattaaattctaaaggattgtcattcaagcaggagaaaataatggcagacataaggtctgaaatgcaaaaaggaataataatggataaaatccaaattgagaatataaaaaaagtgaatataaagataataacatctaatctttaaacttaaaaataagatacaattaaaatacgggacaactatgtaagtacacaggatgatcatcagagataatacctgcaggaaacagctaccattccaaagacggggtgggaggggtgggaacaaatggaagtaattatcaggacctagaagcttggaggcaggaaccccagccttctaggaaggggtgctgcctggctggtgctagcatttcaggagcttgaagaggccctgcagagctgatcctcagacctctgaagaatgtgtactcttggctgctgctgttgtctctcaaggggcaagaacagtcagttgtgagaatgccaaagaaactggagataggaaccaacaaattgatgttgctggggcaatgttgccaggagcattatgcaaaaatgagaaagaatggtctcttctcctgccttacaatatccctatagggcccctgacttagtctgtgtagtgttgctatgaaggaatgcctgaaggggagtaatttataaagaaaagaggtgtttttgcctcacagttaagtaggatgtaaaaggagcatggtgccagcatctgcttctgatgagaacttcaggctgcttccattcatggcagaagggaaagaggagccatgatgtgcagagatcacatggcaagagaggaagcaagagagaggggagggaggtgccaggctctatttaacaaccagctctcatgggaactagtataaggagaactcactcattgccatgaggatggcaccaagacattcatgagagatctactcccatgacccaaacacctcctactaggccctacctccaacactggggattgtctttcaacatgaaatttggaggggacacacatccaaaccatatcattcaaccccattcccacatattcatgtccttctcaaattgcaaaatataatcatcctttcccaatagtccccccaaatcccattccagcatcaactcaaaagtccaaaatctcgtctgagactcaaggcaagttccttgcacctatgagtctgtaaagtcaaaaacaagttatttgcttccaagatacaatggtaatacaggcattgggtaaacattcccattccaaaatgaacaaatcagccaaaaggaaaaggtaacagaccccatacaatctgaaacccaacagtgcagacattacatcttaaagctctaaagtaatttttgactccatgtcctacatctagggcacactggtgtgagaggtgagctcccaaggtctcaggcagcctgactccatgactttgccaggctcagcccatatagctgctctcactggttggagttgaatgtttgtggcttttctagtctgaggttgcatgctgatggtggctctattaatctgggttctggagggtagggtcctgctcctgtggttctactaggcaatgctctagtggggactctctgtgggagctccaagcccacatttccccttggtatcaccttagtagagtctctctgtgggggcttcacagctgtggcaggcttcttcctgggagcccaagctttccaatacattctctgaaatctaagtggaaggcaccaagcctcctttactcttgcattctgggagccttcaggtttagcactaggtgaaagctgccaaggcttatggattgtaccctccagaaggccaagtggcctgagcagtatctggggccctttaagctgtgggtggagccaaagcagctgggatgtgaggagcagtatctcaaggtggtacaaggtagcagtgccccaggcttgtcccctaaaaccattctgtcctcctaggtctctgggcctgtgatgggaggggctgagtcaaagaattctgacatgcctttgggacctttttcccattgttctgactattatcacttggctcccttttagtcatgctgacctctttagcaagttgatgcaccatagcacccttaaattcctctcctgaaaatgctcttcccttctctaccacatggccaggctgctaattttccaaatttatatgttctgcttccatttcaattataaatttcaactttagattacttctttgctgccatatctgtttgtaagctgctaagagtagtcatgccacttcttgaatgctttattgttggagatatacttaatgctaaatgacgagttaatgggtgcagcacaccaacatggcacatgtatacatatgcaacaaacctgcacgttgtgcacatctaccctaaaacttaaagtacaataataataaaattaaaaaaaaaagaaaaaggggtcagttatgtagtcttcatcccttttatatttttctgtgactctttgaaaggactagcagacatttctgtaaagggccctatattcaaaactgtaggctttgagggccataagatctctgttgcaataaatccactcctcccttgcaggtgaaaacagcactagacaatatgtaagtatagataatatataagtgaatgtaagggctgtaagtgaatgagacccactgtattccaataaaattttatttacaacaacaacaacaaaaaagaaatttcttctgccagataccctaagtcatcactcttaagtatggctttccacaaagccctgggacatgggcacaattcagccaagttctttgctacagggtaacaagggctgcttttgctccagttcccaatcagctcctcatttccatctgagactttgtcagcctggcctttactatctatatttctgccagcattttgatcacatccatttaaccaatatttaagaagttccaaatttccccttgtctttctgtcttcttctgagccctccaaactcttcaacctctgcccgttacacagtttcaaagctgcttctacatattcaggtatctttatagcaacaccctgctacttggtaccaattttctgtattagtcagggtcctccaagaggaccagaactaataggacatatataaaacattaaaatgtataccatatatgtatatatacacacatacatacatacatgaaagggaatttattagggagaattagctcacacaattacaaggtggtgtcccataacaggctctctgccagggggagaaagatagaagctggtagcatggcccctagggaagctggtagcatggctcagtccaagtctgtaaggccccaaacctggaaacctgatagtgcatcccaattctaaggccaaaggcctcagagccctggggtggctgctggttcaagttccagagtccaaggctgaagaacctggagtctgatgtccaagggcatggggaggaaagggtatactgctctgagagacagagagcgagcaaaagaaagaagagcaagcaagctgaatacccccttcttcttcctgctttgttctatcaacactggcagcccattggatggtgcctactcacactgagtgggcagtcttcctctctcagtccactgactcacatgtcagtctcctctggaaacagccttacagacatgctcaggaacaatgctttaccagccatcaaggcatccctcaatggagtcaaattgacacaatgttaatcatcacatcccctctttggcaggtcctaacaaggagccagttggctgatgaaaaatgtaatttgcaggtcccagccccagcatcaccaagtggaatatagaagggtaggtttggagctgagctattaataactggaatgtgcattcagtaccagtttttcctgagtacaccattttaatctgtatattcaaggctcctttgatttcagcagtgttttcttgatttacatctatgaattttttttaattccattgtttggcccttagttgtttttttttcatgtgggctatagattggtgaaaagaaaccactccatgtacacaccatatggcgaaattaacttccagtttgtttaacatggcatatataaacctaacagtaggaaggtggctacacagtatagcttggctctgaattggtttcagaggtcctaactcccaccactaaactcttaacaggggctgccattgcccctttctgtacaagttggggtcctggtggatctaagaagctcaatttcatgtttgtaatccagggtaatactctgggaaaatactaataatgtcgtaaagatagctgtattttcctcattccaggcctaatttagaatcccaaatcccttctcctagtgtctgagaaaagaaatccaaataaaaacaaaacatattgaagatgaaaaacaatacagtgactagttttaagatccttctatttctggttctatttagagcccttgactaacaaacttgtcccctgatctttacctttacagatatcaagagtgactgggcacatgaagtccaattgaaggttgttttgtctgtatgctgatgcaaactttagttcacagaaaccttttggtctgtaaattgcattttgttttagggtttttgcttccctccatactgatgagtgttgtgggtggatttgtgagctctcactgctagttaagcatctgctattcatcatcctgatatagtcatcttttgcattttacttttcaaatggcaagcttcatcagaaattaagcactttttactagagacactatttgactcacaatctgacagattctaagcttaaagggaatcgcggggggggggagctgataataacatcagctacaggaagctgtcatgaatgggtttactaactcaactggagcccaaaatgaaaggaagaatatgaatattctcttgacctcactgtcttctggtgacactttagagctggctccatcaatttatattttcaattacacctgctttactggtccttcccctcacttatatttttacgtctatcctatattaaaaataattatatcctgcctcccacgagctgccaaactcactgcactcaaacttcttgaaagaattctcataatcttctcaccatttatccccttgaaatgtggatttcatttctgccacctttctgaaaccactcaccagtgtcacagataacctactaattctaaatccaattgctatatccttctttctattcctctccacctctctccctcttttgatgttcttaagcctctcttctcctgacttttatgacactgaagcctctttgttctcctaattctggatactccttctctgactcttgcactgattttcttcctcctcttgcttctaaaggctctccaagactctgtccttggttcttattttttctctctcttgaactttgatgaattaatcaaagtccattgttttacctacgaaacctatttctcttaatttagttatttcttcaagctctattcatatgtttacaacttcctgatggacattactccctgaataatccaacagcatatcaaactcaacaggtccaaaggtaaattcattatgtcctctcacaaattatctccttttcccaaaagctcaaagcctatctttgctcttcccagtatctaatcaattgccaaatttgtaagctctctgcctttgcaacattttcatctgcccccttattccattctcactaccactaccctactcccaatcctcacaatcattcatattgtcttttctaataaccttgcaatttatctttccctttccctcattcctttcctactccaacccatcatacccaacaaagtcaaattaatttcctgaaggagtgcaatgattactcacctgctcaaaaaccttagtagctcctacttctttttagttaagtgaaaatttaccatccctctgtttaagttcctctgtaatctatcccagtccatctatgcttggcttctaccataccctacaagaaaacggaattatttattgttccttagacctgtccccagattgtctacttccatgccttttttttcatgccactaccttcatctccgcttgttaaaaccctgaccaatattcagtataatttggacatcttctcttctgtcttctcttgtaaagacccggttgaaacttctgccaagagcccagctgaaactcccatcacagaaagtattatattgtgtatttgattatagttttctgtgaacttgttttatgtcactactcagactggaacctttatgttttattgagtaatacactgaacagtgtcagtgctccagataggttccttcagatttctttgccattttactatatgtgtccttcctccactgatttcaatgttctttgaattgccacctttcagtgggctcttctttgaaagctgccctcaggctattggagctattttgcccacaggtcagaggattagttctgagagttttcatccctcacctctacctggtggtgactgttaaccaatggctatagaatgtgggactttgaaagcacaactgtttgacttcaggatgatacaacttggaggcctcacactgcagaatttcctggcaggatcaggctgaagttacctcttgcagaatggctgccgaaattttgccctttcttcctctcctctgttcatctcatcttcataggaagatgagataggaatccatctttctgtctctcagggtctgctgcttgggaaacgtgactaggacaagtcatgtttttgagtacttgccatgtgtcaggcaccatgctaaatgtccacatatgtaatttcccttaatttaatcctcttaaccgcctggagagctaattattactctgattaatagatgagtgaactggactttgaagagattaagtaacttttttcaaggctatatagctaataagtggcaatgccaagagtccaaacaaggcttcagaggcagctcagtcaaccagtttgctatactccttctgaaactacttcatggaaaggagacttctaatatggccccgcatgagccctgtctcctggtattcacatccatgtacaattctctccccttgggtgtgagctggacctagtaatttgcccctaacaaatagaatgtggctaaagtgatttcacttccatgattagttatacaagactggcttctatcttgctagcagaacattttgctgcctttgattcatcaagttgctctgttggagaggcccatgtgacagggaattgagagtggcttccactcaagagctaatgaggaactgaggccctgaaacctgccagcaaccacataagtgagcttggaagtgagtccttccctgctggagccttgagatgaggctgcagccatagtcaacatcctgattgtagcacatgagagactctgtgccagggggctcagataagctgtgcctggatttctgacccagaaaaaataagagataataaattatatatatatttcatatatataaaatatcacacacacacacacatatatatatttgagacagggtctcactctgtcacctaggttgcaaccaccccctctggggttcaagctattttcatgcctcagcctcccgtgtagctgggactacaggcatgccataccggctaatttttgtatttttagtagagatgggatttcaccatgttgcccaggctggtctcgaactcctggcctcaagctatccacccgtctctgcctcccaaagtgctgggattacaggcatgagccaccacgcccaaacagagtgtggtattttttaaaagcctgctgcttggaaaacagagagtcaaccttgttattcagtgtaacacttgaaacctccagctcagtgacttaccaatagatgctaactaataatctatcacctctggtggttttatggtccaataaacttagctaggatggtggtgataaactgcttgaaaagcattaactttccaatgtgataggtacttgataaccttggaaccaagtaaacaacaaataaattaccagcgaggattgggtaaagatattattttaacgcatccaaaataagcctttggttttgtgcttgtttcaattaattaatcaatcgataagggacagtacaaattgggcaccagctggcttgttgctcaaccataagcaaagctgtgttcagtacctcccagtcaactgcatgtttcccaacgtgtgcctctctctgcccctgcatactcacccacatacagcacattgtcatgtaaatggaaatcaaccaaagatgtttttccaattctttattcctctggttgccatgggattacagatcagaagtcagagaagacagatgtaaaatagaaaaagatgcagccctccaactaccccagctgcctgaaagcatcctttgagtaggcaagaaaaggtaataatgagatggatgacattgagcgacagtctgtcactatgatggtaggagtagaagaaagctagaagataaaggcaaatgtataatgtcccttgacccacagagaaacctgcccaccttccgcatctttttcaaacagtggttggcaacaacttgggcaaccaactgtcctgatttgttggaaactgtcctcattttagcactgaaagtcctgtgttcctggaaatagctcaatcccagataaaccagaatggttggtcaccctagcaacaatcactaactcccaaagggctcagctcccattgatatttgctttttaattggaagagtcaataaaaagatatcttcttaaacttttctctttgaaagctgtaattatcctattggcagaatttattttttaaggtagtgccataaattctattcctcccactaaaaagtgaaaaaaatacattagaaggttttactaattttattcagatgttatatttgagctgaaaggtgggggaaggagacaggagagtgagtttggaggacagaaagctgtcaaaaatatggactaagggcatatttaaatttgctggtacattattaattgaagaaatcatttgtctgaattcaaaggcacaagttaaatatgtcagtagtcactctttaaactctaaagatctggaccctacaatctgcaaattttacagctagaagacaccttggaggtaatctaacccaaactcctgctttttagacagcattcaaagaagctcaaactttcattttgctgtctgttacagaacacagctttggggagctcttaatagttgttacatgataaaaaagtttccttggtcacataagtttaggaaatatcaaggtaagcaatgttaaacaagtttcttgactgcagaaattttctaggcattttatatgcttgcaatcagtgactctcattcaatgtacattagaatcacctgggggaacttttaaaagctataattgactaggccccaccaagatctaggaaacagaaaataatccctctctggatattgccgatgttcaccctgattaagaatcaccagctatattcctgagctctctattctgttccgttggtgtatgtatctgttttttatggcaataccacactgtttagttactacagctttataacgtattttgaagttaggtaatgtgataatccagtttgttctttttgcttagaatttctttgaatatttggggtccttgtggttcagtatgaattaggggttgtttttttctatttctgtgaaaaaaaaatcattgaaattttggtggagattgcattcaatctgtagattgctttggatagtatggacattttaacaatactagttcttccaatccatgaacacaggatatctttcaatttatttgtgtcttcttcaatttcattcagcaatgttttatagttttcagtgcacacgcatgccactttcttggttaagctgattttagacaaaggtgccaagacacacaatgggaaaagaacagtctcttcaataaacgatgttggaaccaccggatctccacttgcagaagaatgaaatcagacccttatctcacaccatacacaaaaataaacttaaaatggattaaagacttaaacatacctaaaattgtaaactactaaaagaaaaacagaggaaaacctccataacattggtctaggcaatgatttttttatatcactccaaaagcaaaaatagacaaatgaaattatatcacacaaaaaactacacagcaaaggaaacaatcaactgagtgaagaaacaatctacagaatgggagaatatatttgcaaaccatacatctaataagaagttaatatcaaaaatctataacacactcaaacaactcaatagcaagaaaacaaactgatttaaaaaaataaacaaagggcttgaatagacatttccccccaaaaaagacatataaatggccaacaggtatatgaaaaagatgcttaacatcactaatcattagggaaatgcaaattaaaaccacaatgaactatcacctcacacctgttagaatgactattatcaaaaacattaaatataagtgttggagaagatgtgggataaagggtacacttacacagtgtaggtgggaatataaattagtacagccattgtggaaaacagtatggaggttccccaaaaaacaaaaataaggccaagcacggtggctcacgtctgtaatcccagcactttgggaggccgaggcaggtggatcacgaggtcaagagatcgagatcatgctggccaacatggtgaaaccacatctctactaaaaaaatacaaaaattagctgggcatggtggcgtgcgcctgtaggcccagctactcgggaggctgaagcaggagaactgcttgaacccaggaggcggaggttgcagaaagccgagatcgcaccactgcactccagcctgctgacagagcaagactctgtctcaaaaacaacaacaacaaaaaccaaaaaaaaacaaaaatagaactaccatatgatccagaaatcccactacttgatatatatcccaaggatgtgaaatcagtatgtcaagaagatggctgcactcccatgttcattgcaacattattcacaatagccaaggtatggaatcaacctaagtgtcaacagatggatgaataaagacaatgtggtatatattggaatggaaaagaattaaatcttgtcatttgcaacaacatggatgaacctggaggacattatgttaagtgaaataacccaggcacagaaaggcaaatatcacatgttctcattcatatttgaaagctaaaaaagtgaactcatagaagtagagaatagaacagtgattaccaagggggtggggtgagggtaggggaaagactggggagaagttggtcaaaggagacagcatttcagttagacaggaggcatacgttcatgacatttattgtaaaacatggtgactatagttattaatgtattgtattcttgaaaattgctgagggtagattttatgttctcaccacaaaaaagctatgtgaggtaatgaatatgttaatcagctcaatttaactattctacatttgcatccatatttcgaaacaacatttgtacatgaaaaaatatatacgatttttgtcaattaaaaaataaaattggccaggcatggtggctcatgtctataatcctagcactttgggaggccaaggtgggtggatggcttgagcccaggagttcaagatcagcctgggcaacatggcgaaactttgtctctacaaaaaatacaaaaattagctgagtgtggtggcacgtgcctgtagtcccagctacttgggaggctgaggtggaaggatggcttgagcctgggaggcagacattgcagtgagccgaccttgtgccactgcactccagcttgggtaatagagcgagactgtcacacacaaaaaaattaaaattaatcaattttacaaagaactactggctaatatgtactgtgaatctatgagagtaaaaaaaaacagtctgcaatattttctaaccttatttgacaatacatatttttcttccttcctttgtttcttccttccttccttcttctctttcttccaccccctttctttctttttgttttggctttggaagatactggtttatatttgaggttttgtttgtttggtcaacaagaagagaaatagaaaattattaattatgtctctaaatatactttatttaaaaacagattatgctttatttaaatttttaatataaaaaaatttaaatcatatggagaactaaggagagtagaataataaactcttttgtactatcacttagtttcaacagttataaatgcatgaccatcttgattcacctatattctcacctacatcccccctttccccaccactgaattcttttgaagcaaaccccagataactatattattttattcataaatacttgaagatctatctgtaaaagattaaacactttaaaatataattgtactatatcacataaaaattaataattctttaatactgttaaatattcagtcagtatgcaaatttataagaattgacaccttcatgataatgaatcttcctaacctagaacatggtatgtcttttgatttgttcatgggcattttcatgtatttcagaaatgtgaatacattagtttttctcatgtaggttttgaaactttttaaagtaagttttcacctagttattgtattttacttattttggtttatcctttgccatttaaatgacgtcttctcttccattgtgttttctaacttcattgtttgtatatgtgaattttaatcagctttattaaggtctaatctacacgcaacaacatgcacagattttaagtacacagttcaatgagttttagtaaaaatatatacccatttaatcactatcctcacagttcaatgagttttagtaaaaatatatacccatttaatcaccatcctcactgatttttaaatgttgatttcataacctgctaacttactcaatttcacgttttaatatatactctcaaagttcttactagctttggccaattattaaaaggtatcacattccaatttctgtttttggttttgcttcttactcgatcccaccatgccaaaaagattttttccagtccatgttgtaatagaaataaattaaatgtcaaattgtgactgatcctagagatttaaattgctattacagacataaagaaacatgatcctctttgcaacaggtgtcatgctaaatacaagtttagtgatgtaagcagctaataataattagaatgtaagctgactcaagaatggatatccggctcattaatatttgcttcatagaaataggctcaaatgttcttctcgagtctgagtaggtacattccctggatgcttagaggaataaatttatgtccaagcccagcactaaggctatcattactcacagaactccatgtgacccctagctggaaaaatgtgtttaccaagccccagctgttgtatttatgaatgtttaggaagctgaaatgactggcattggtctcagtgcccctaaaatgtgacgagttttttgaaagttgcaaggcagccaactcactcacctagatgagactgaagaaaagcagtagcttttcatgggagtagaggctttccaggctgagtatcctctggggtcatcaacaccctgaggatagtctggtacctacctaggggcaagataatgagcaatatatagagcaaaggtggtgggggcaaaagggtgaggcatgctggttggaagaaaaaaaatgggttattccagaagttcttagagccgatagagactgtaaaacataatttaatacttgactcttgtctttgtatgaggtttggaaaaagtgggccttgagcaaggatttgactgcaattcgtttattggaagagggggtataatcttaggaagcatggcaaaagaaaagaaggaaaatcaatatactgggtgtaaatgaaagggttactactgtggacaactggggctcaatgtcactggccaccttctgagatattgggtaaaatatgcctcagaaatatcctgctgattgctgaggatgctcagatatgtatccactcatttccatccctaatcagtttagggtcactattagggacggggtggaagttaacacttgacacttctgtcctaccctactggcaaaccaagcatgctcccatggccagagagcgccctctggcaaataaccgtatgggtatgggacttatttacaggaaatttctagggtagagcaagaggataagagaactacaattttatattgcttatgttgctctctggttgttttttatgtgtgagttttatctcaccaacaacaatgaaaactctttgagtgtaggggctacagcttatatttgtgttgattcctcccataaattctggtgagctccttacaactgcaagattaaatccattaagcccttcatgattggggggccctgccttcctctccagacttttctttaccatccactttctcatcccaggcatcccagccattcctcaagtgccttctctctgcatagaataccccttcctcccgtgtccaatgggtcaacactgataatctgtcaggatcagctaagtagctcttctttcttaaagtattccaagttttccccaagtaatcatgccctcttttgcaaaccactacctggttcttacttctactgtacaatttatcatactgtactgaagtcctgcctatcagaacatgagctcattaagaaagtaatgtgtctttatccaaagcacccagttcagtgcctgctatggactcaatgctcaataaatacttttggaatgaattaatgaacgttaccaatagatactttctgattaaataaaacaaggagttggacataccctctttggataccctaaaattcccctcaaatatttgattgaatgtgtggtcaggaagaatattccccagaatagtgtgccaatgctcttcagccaaggatgaccaggaacatggctataattcaacaacatgggtttttactcattgcagtgaggaaacacacatcatgggggaccttacagtgtctcagtaagagtgtgttagaaagaaactattataaaattggggctttggatgaatgttggggaggggaacaaagaagcagggatttgctctcgatcagatgctgtcagaagtggggtcaatcctatgattgggcctgttgtgaaaggcacagtggctcggattttgtctgtgcttagacaaaattatgaagtgaccttgttttgtttcattttctaatggtctcaggttatctttatctgtgtttggtattctgtgaggttgtttatgtcccacaggaaaaaaaaatggcctggctgtgagcatttggtcagcctgtaataatactgaggtgtaactgtgaacatcggagaagttctgaacatcaggagatgctttttttgaggtgacgagagaaaggcccaaaagaataagattatatgtacaggtactgatagcagtcgcaagggtgaaatgagagctgaatagaagagactaaaaccgaaaagcaaactcgatcttccatcatgctctgtgacctttcaggttgagaagaatattaaatcctgaagctctgcttagtcctaaatgtatataatggctaaaataaatagattttttcaacagaaaagcaagaagcacagatcctcctttgaagatataaaccataagccctgaaaaattaaaatacttaatccagcagcaatatcacttgtgtagcaataaaataataggatttcctttgcctccttgttttggttattctctcttctaaaaaattgttgacatacttttgggtgataagagttagataacaaatctgaaagtatgtagtttgtattttggaataaaaaaggaatatagaattttctgttggttaaattgtttatgaagccctgcgactggaaatctaattccaaatggtcacttaaaagccattacactgtttattcaacaaattgttttagaacacttagtataagttaggtaccacggtagatgcaggagttatgaagatgaataaaacaaattcttgtactagaagagcttacagtccatcagaggagacaaacaatcactgacataaaacaaacctactaactccctgtcagagtttccacccctggcaaaggaagtgacagaacagttgccagacatagagaaagtatagccttgagcaactgggtcccaataaatagtcagtctgatttaaattatctgagattgatttttcagggacaactttttatttaaatataatttcaaacttacagaaaagttgcaataatagtacaagaactctggtttacctttcatccagatttaccaattgctttcctaaccatttgcaagcaagttagagatattgcgcccagcaatactaaatacttgagtgcatgttttctttctttaaatttttttttaattccataggtttttagggaacaggtggtatttggttacacaaggaagttctttagtagtaatttgtgagattttggtgcacccatcaccagagtagtatacactgaacccaatttgcagtcttttatccctcgccccctcccaccctttcccctgtgtccccaaagtccattctatcattcttatgcctttgcatcctcatagcttagctcccatttatgagtgagaacagacaatgcttggttttccattcctgagttacttcacttagaataatagtctccagttccatccacgttgctgcaaatgccattaatttgctcctttctagggctgagtagtatatatatatatatacaatttctttatccattcatttattgatgggcatttgggctggttccatatttttgcaattgcaaattgtgctgctataaacatgcgtgtgcaagtatctttttcgtaatgtgtgttttcaaaaagcaagaaaatttccctatctaaccaccatgcaattattcaagtcaggaagtttatcactgatacaagaccattatccactccatggtccatttttttttgtcattctttttttttttaagtctttgttaacctagggtaattccacagtctttcttgaccctaacactgagaattccaggccagttattttgtagaatgcccctcaatttggatgtatgtgatatttctcattaggatattcagggtacaaatttttagcaggaataagtggttgatttaaaatctcagaatagctgcttctacccacatctccctcactttgacctgacattgtgcgcaattgggaagcttttgaggttttctggtgaaatccagacttttctctgctttctcctatgatctctaatttagccatcagaattgctaaaatcctgaggagaatatttgcttcttggggagtttacactaagcagaaagcttacattaattcaaaactcattcctaatgtgtgtccccaccccaatcccccagggattagtacctgctttattattattgcaatgaataaattattcatcagggtggctaaacggcttacagagataaataacactacatgagtgtaataaagatatttcccttttctaaataagtagcacttgtaactcaacctgtaagactgtgcttctttccagagaggaagagtcctctaaatggtacctgaagagcaagagctttaaacaggccctagtgcaaaagagttcaaggcctcagtgatgcctagaattctgattgtgccaattcagtccctgctccctcactctggtatatccaaggctaccacaaagtggaaggaggaggatgtgtgggcgaagagtgggtggagaagacttccaagaattggaaactatgcagactagcagccggtagttaattagttttacttctgaaacgacccctttgtgcagcttgtccttcctgagaaagaggttaaaatgctgccatggctgctttttagcagtatagtgattaaaacaatcccagggcctaaataagatgactctacttgtttggttgaggagagagtggtcctccttcattttctttttctcccctcctactcactgaacatcacatcaaaaaatgagcaaattcctacactttacttcctattcctataggagctatttagagggaggaatgctcattaaaggagattctagaatctaaagttgcctgttttactgaaactgggaagcaaactggagatgttactagcacagctaggacacagttgataaaagtagctaacatctattgtgcatttagcatatgctgggccatcgcttaagggcttttcatggtttatctcatttaatcatcactacgatctatgagttgggtagtgttatgattatgagcatatatgtccagtttttcagatgaataagctggggctgagaaaggtgaagggactgggccaaggtgagttagaatggaggcaggatttaaccacagtagtctggcccagagcccattgctcaaccactgtgctacctgccttccagcttccatttgcctatagtctagtgggagtcataaaagaactaagagaagaagatgaatccagactggaagtggatgggctcctggctaggccaggagcctcaccagtcagagaccctggaccccctggccaagctcaccgcgggtgaagaaaaaaatccacccctgctcagcctggagcgagaaggtgaccaaggaggaaatggtggcagccaagctcagcatgaccgtcactcacagcaatgagaagcatgaccttcacgttaccctgcagcaggtccagcggtgaaccaattgcccaagacctgacccaggttgttggagaggccacaggggttccactgtcttttcagaaactcatatttaagggaacatctctgaaggaaatggagatacctttgtcagcatgtggaatacaaaatggttgccaagtcatgttaattgggaaaaagaacagtccagaggaagaggttgaactggagaaattgaaagagttggtgaagcctgtggagaagaaagctgacgaactttaagagttgaataaacagcttactggactccagcaaggttttctggccaaggatttgccagctgaagctctctgcaaacttggtaggagaggaaaagccacaaccaaacagtttatgaagatcttggaagagatcgacacactgatcctgccagaaaatttcaaagacaatagatcaaaaaagaaaggtttggtaaaaaaaaaaaaaaaaaaagtcagacgttcgtagctgagtgtggcacagtggagcagaacatctgccgggagacccagcagctgcagtctacaaacttggccctggctgagtaaggtgtggcagaaagaggctgtgctgccctgaagaacagcaccaccagctctgccctctctggagcagaatttacctgatttattctagggacaactggcctattgccaattttcctattcctagcccagttctcagtgaaaaactgttgtccttgtgatcttgagtagggcgcttgtctgttttctcattgtgtctctgtggctgtgtggtccagcagcctactttttctggagagggcctcccctgcccaggttttcccagctatttgaccttctggtgctttctttgggctggtgagatctctcctttgtcctgagctagttctaggtttataggccaccctggtcttcagatacatgagagcttttttgctcttgtgatcacacagtcccatagatgtaaaaccagaatcactaggaggttgcatttataatcaggaatgttgagaatggcttagaacaggtgttcggcacatagtagtccaagtgtccctcattgtgacttaattccagaacatcaggctgggttattggtttataggcattgttcttaccttttagtgacctgactagcctcaagacatgaaatatcagggggccattcctggaatgaagcgtatggttgatgcatggacttcctcgtccccagtaaaatcttcagaacccagtgttgactgagtccgtgcttgaaaccaggcatagcaatggcttaggcggggcaaagagggggagccacaatgaataaagcaggctggtggtgaagccaaccataaatttcccaggaatgacatgtgcttccttcaagggcatttctgttaaaaatacccttctgagatctgtatttccttcaaggccattcttgtccattttgtggattctcttgcagaatcactgttattgaaaaagtttgagcacaggtatggtggcacattcctgtagtcccagctgcttttggaggctgaggcaggaggatcgcttgagcccaggagtttgcatgtagcctgggcaacatggtgagacgccatctctaaaaaattaaaaagttaacgaataaataaataaaacagtttgaatgcccatcatcaagcagaagaatgttttctttttgttttggttagtgagaaaaaccattctgtggttctaggcataatttatgtttaacagagtagccacaacgtttaataagaagttactgtgtcttggacattgttctaagtttttaaatatgtattcaccatttaatcctcacataacctaagaagtagacaggtattagccccgttttggagatcaggaaactgagaacacttaggtaatctgctgaaggtcagacagtacatggcaaaaccagggcacaaagctgggcagtttggtttcagagccactgtttttacgctctaccgtactacctctcgaccaacatagggttacatgctcccattctctatatcctctccctatacttttgtcttccatgttagtctttccactttctctctggccctctctagttcattctccccagagcactctgagtgattataaaatacaaatcttatcatatcagtcccctgctcagaaacctccaatagctcactacttctcttaggataaaagccaaagtccttacctacaccttctcccatctcatctcgagcccctctcctgtttgctctctgctgtcagccactctggtcttctttcaggtcctcagatgcactgtgccctctcttacctgggggtctttgcacatgctgctacttctgcttggacagctcctcaccatccttcctccacccccatcccttgtgtacataactcttattcatccttcagaatgtaacccaaagtctcttccatggagacctcacctactctcttgagaccatatcaggcccccagatgtgatcctctcatggctacccataacttttctttcacagcattcaccatagtccatgatagcttattggtggaattatctggttagtatttgcctttaacactagactgcatgttccttaggttaaggagcttctttgtcttgttaacagcattatttcaagtacattgtcttgtatatagtaggacctcaataaatatttggagaacaaaacaaacaaacaaacaaggtgaacccatgccagatgactgggttgagttggtcagggaaaatttcacagaaggcagattggaactaggctgaaaagcaggctgggtttgatttaatgaagtgggctatgaagagcattccaggtgaggggaaccaaaggagctttacacgtcctgggaccagcaaactgagcagtttggctatggcagagagctcttgcagtcatttgcaggagacctttatcacacttctaatccatgagaagtagcagggtgaatgtgaagaactctcagagcccagtgactattggtgcatattagccagggcacagcggcactgcaatgacaaggcgatgggcctgccaagccctccccacttcctttgggctgccagcattcctctgagtctccatgaggtttgtttaattcagggggtggcagtaggaagccctcacacattctccaatttggctttaccatcagcaaagctattttgattccaatctggcttcttggatgcaaggaaagatgagcaattggcacccccaaaacttcaacaatgggaaagtaatagaaaattcagtttaaaaggtattaataaattatacagggtagactaagaagagtcttgaaggctggtataaggaacttggtcatacaagaattattataattctctgtgcaagtacacacacacacacacacacacacacacacaatgtttatccatagaggaaatcactgtgggacttgtttacaaattaatctcttgaaatttaatgtcatcaaattcccatcttccacaaataaatttgctgagaactttaagtcattagcaagtaagtgttttccaagaattatttgatgaccaaagaacagtttaacctacttgggagactttaataaagctttcttctacagccccattcttgacattaaaaaacataataagtaatggtttgacaaatattatgtattatttggaaatacattttctcatccttcttcacaaacattttacctcaaattacagcctttcaattggtctcataggattaggtgattttttttctcattcagatttatgtgtctatatttgtgtgctaatttgaaaattaagtacatattttaagtacagagatacgagttttcaatccaaatctgaagacaattgttaactgcttctgaacatctcttactgccaacaaccagcaaatgggaaaaactttctctagggaaacagttcccagtatattcttttttattatcaaaatactttgcacaaaaacaggaagatacagttttctccttaactaagcaaaatagttgtcccaatctctgcaaaatattcttcctatgactctgatccttccatgataaaagaaatgatagcatgcctttggtcttcctgcttcaggaagcaaaggaactgtaggaaaagaattaatttttcttctcacttttgaggtttgagacaaagttgtaactccagcttttcaaagtgcaaagaaaacaattcacacttattactatctgtgggacacaaatgtatggatttaggaggaaatagctggccagaaaaatgaaacgcattttaaacaaaatgctacacttgctgcttctcctctcttggcttctataatttagcctccatctgacccacctccattgtaattgctttggctctcttagtgttccttaaaattatcttcccttttctctaaaatgaactgcagagccatttttttaatctgcattttaaaaatttactttatttatctacttaaaacacagccttgttccagggggggtttaaggtggcttcaaaggatccataacatacaccaagaaatgaataacaaatgggacaagaatgaagcttatactaaaatgcttatacaattctactcatttactctgggtagactacaaatttgtttctaagctttctagcaggcagtctagaaaaggaaacttaattagttacatcacttacagtgtctgtaaaacaaaaacaaaccaattatccaagtgaagtgctagtattcctaatactaagaccagaacaaaatttctcttgagaggcttcataaaaaggtcagcatgtgatgtaactgccagcgttctctgtagcaaccaaatgggagatgcaatgatgaatttcacagggttcgtactgcatttctctgaaaaggtagatggcatcgcattaacttgaaaaatcaggaaaagcaattttatcatgagtttaggggtttgagggggagggatacaatatgatatattctagatactcacctctctgctctgctgggcaaaaccaaggataacagaacaatccagtacccagaatggcctcagggaaattattaaaccactaaaactgtatgcaacattttgtgaataggaaactgtatttttcctgacagacaaaatgcagttttatcagatccttaaaatacacacgtgactcacaaaagaacaatttcttaaaaactctagagttttaaaccgactgcagatcctgcgtgctactctgcaaacatttttttccctctcagcctagcattttttaaaaaaaaatttgcaaaaagaaccttttattgtttccatttggtccacggcttggtgagtacttctggatgttgagaagctcaggccgaaatcccgaagccagaagaatgcagaggggcacctcaaaggttgctgggctctggaagctcccagtcgtccttgagccttctgaagagatactccaccagcccggcctggcggctggccagcctgcagaggttggtcaagtagttgcccatcttcttgatgagtttcacctctcggtctaggaagtgcttttccagaaaatcacagaaattgggatctgtgttggcagaacctagggcatgcagatccaaaaaggcctggttcaggctcttctccagggccagggcggcttccatggcggccaggctgccactccactcatctcagagcagcttctgctcatcttggaagaggccgcagctgctgggctggttctgcatcaaaagatgcttggcaccctcgcatttctcttcagccagcttgcgaaagaagtggcccacgcccttgagagccacttcgtcgccttcgaaatagctcagagagaggttggtgtaggaggcctgcagatgcatgttgatcaggcggtcaatagcggcctccacgccagaggtatacttttggcggctccgggtgctcatggttggttggcgggcaaccaggagctaaccacaaaagcttgttagctggtcccagaagcgagagataattgagcagatagtcacggaagttgtgagtggagaggcagggttagagggtggggagaggcagcatggggagaggcagattggggaaggtggggagaggcggggtggggaaggtggggagaggcggggtggggagggtggggagaggcggggtggggagggtggggagaggtggggtggggagggtggggaaaagccgggtggggagggtgggaagaggcagagtgcggagggtggggagaggggggtggggacggtggggcttggtggggttgggcgggatcacagggcacagaatctctcagcctagcttttctttttttttttttttcttgcatgtaagatttattttgatgatatcattcagccaggaccctggtttattagtaacattgtacatattcaaatttcttaaagaaatttaattttttaaatagattaaggggctacaaatgtgcttttgttacatgggtatattgcatagtggttaagtctgggattttaggatacccatcacctggatagtgaactttgttcccaataggtaatttttcaaccctcaccaccctcctttcccacttgggagttccaagtgtctattgtttcgctctatatgtccatgtgtatccattgtttagcttccacttataagtgagaacatgtggtatttgattttctatctctgagttactcaggataattgtctctagggccatccatgttgctgggaaagacatgatttctttttatgtctatgtggtattccatggtgtagatatatcacattttctttttctaaccatccattgatggacacttaggttgattccatgactttgctattgtgaataatgctgtgataaacataggagtgcaggtgtttttttgatatcacaatttatttttctttgggtagacacctagtaatggaattgctggatcttagtagttctatttttagcttttcagaaatctccaatctgttttccatagatgttgtactaatttacatgtccacaaacagtgtatgagagttcccttttctctgcatcctctctaacatctctcgtttttctgactttttagtaatagccattctgactggtgtgcgagggcatctcaacgtggtttaaatttgcattgctctgatgataagtgatgttgagcattttcatatatttgttggctgcttgtatgttttttattgagaaatatctgttcatattatttgcccacttttaatggggttatttggttcttttctttttgaatttttggagttccatgtacattctgggtattagtcctttgttggaagcatagttcacaaatatatttctctcattctgcaggttgcctgtttactccattgattattttttgctgtgcagaagcattttagtttaattaaattccatttttctatttttgtttttgctgcatttgcttttgaggtcttagtcataaattcttcgacttgggcaatatccagaagagtttttcctagattttcttgcaggatttttatagtttcaggtcttacatctaagtgtttaatccatcttgagttaatttttgtatatggtgagagatatgggtccagtttcattcttctacatatggctatccaatttttccagcaccatgtattgaatatagtgtcctttccctagtgtatatttttgtcgacctggcaaagatcagttgattgtaggtatgtggctttatttctgggttctcaattctgtttcattgatctgtgtgtctatttttgtaccagtatcatgctgttttggttactatagtcttgtagtataattagaagtcaggtaatatgatacctatagctttgttctttttgcttgactgctttggctgtttgggctcttttttttttttggttccatgtaaattttaggattgcttttttctaattctttgaaaaatgacactgataatttgataggggatacattaaatctgtatattgctttgagtagtatggtcattttaacagtatggatttttccattccatgagcacgtgtttttctattttttgtgtttgacttctatgatttcttttaccggtgttttatagttctccttgtagcttttgataacaatttaattcctctttctttcctaattgttagaaaggagtctttatttgtcatttggctcattttttaccataattctaagatgaggtaagaacatcaaaagtactcatagtgaaatccctctaaatcttcatttgtgagttaaaactcccttgtttttaaatttagaggcttatgtacatatttttttcctgctcctaatccctcattgggagtgaccattagttacagtttgtccaaagtggtcctgttgtcttggtataatgattaatagcacccctttccctctcaaaagggtccttgtttggaatatatattacatggtcaccttacccattgagaaggaaaagaaaacctatactatgaatagagtttgtaaaacattgaacttgaccatgatttgtttccattttattacttaatcataccagtaagaaccctatcataaattttctattcatcactttatattttttattcattgacctaattatttcttctagaaagttctattgaatggcatatgtaccaggtgttttgttaggtactggtggcttcttagggttcaggaccttgctccattaactgaaacatcatgtgaatgagtgcaaaagacaaaaaatacagatttataaatcctaccaaaatagaaaataatccatataagttgaatgagttggccatttcctgttggaagatgttctcacagggtatcctccggctttgtgagtccatgcttagtattttattttcctaaataccactttcctggtgctgtttcacaattagaacacttttgtatgttttctaacaaacaagaaggcatattctattcagggtaaacaagatttgaaccccagagaagagagttttgctttgaactttggacttcggactaaataaaaataaaaattcatttttttcagcagctttcaatttgtattttctctgttgctgaaaactgacatcttaaaatttcaaaaagaagcctggagtcttcctttactgcttaaggtaaaatatgaacacatatcctttatctaaatacaggatatattgtcatttttaatttcatggatggttgtagtccaaaagtattctcatattgcatttgaaatttgcaaaaactgttaatattcagaaatagtcacatttttcaatcttggggggaattaactggataaaacatgagtgcatagttctgcagtcttcctggccttggttctagggcagaaaagaggctggcagtgtagaggaggaggaaaaacaaaaattcaaacccaagaacaaccctagcaggtaactaaataagagataaattaaaccagatgcaatgctctccaaatgactgcaaagaaaatgattgttttctaccttgtacataaacaattaatcatcatattgaccttataataaggaaatgctaagcttagagaaaacttcaccatataaaatattacctgcattgcagcatgtcagggtcatttaatatatttcaatttcctatacatttacttattcctcttggaagagaataatgtctatataaacctttccagatgagatagttttctgccttgtgcaaatgttgacaaatctttccgtcattactttagaaaaaaaaaagagccaatatcagagccatactctggaggtagttaagcacacagccgttagaatcagaccaaggtaggctcaaaacccagcttcgtcactgtgagtgtgaacttaggcaggtaatataacttctattagcctcagctttcttgcttataaaatggagatgttaatatctcacaagtatgctacaaaggttaagtgataaaatgcacaagaaaatgctgccaaacaagtagaaagaactcaaaaaatggtgctatatgatcgatcagttttggaataaaatttcagagatcctctcaaaccccagtaagtatcagaagcagatcccaatatgtttttgatccaagttttctcactgctagacctcttttgctgaatcaccctctgtgggtggctacaccctttcaagcacgaaagcacataggtacagctttgagtgttcaagatcaaggcatttagaacacaagcaaaggcagctcctcttacttcccttggctgagcaagcatcaacaatgcctcccgaggcattgatcgttgtggaagcaggaggagcagtgcaaaggtggcagaagtatgttttctcagttctccagaccaagataattatccattacagaaaaaaaaaaaaaaaaaagaatgagtgcctattttgtaggatagggtaagattctgaaacattacacgtgagtggtaaaattcaccttccctttcactcaaatataaaccttgggatgccttgagaatctttgatcagattccccagaagtagtccctgatatgaggattcctgtgcaagtgatttatggggaaggtgctcccacagggagaccaaaacaaagtggggaaagcaggacagagaaagaagccaataaacaaagcttcaatgtcaggaaatatcacagcttagtcatgatctcaaggtggagctctggggtgcaaatcacacctagagtttatttcaacatgagacaagggaactgggcttttatattcttgcccaatggtcgtgggcctccccagggtaataaaaaactcccagggtacatgggaggtatgtacaagtgaagcaactccattagtccaagagaaagccgccaaagaaggtcacaggtgctagtaactagcagaaaagcaccctgaaattgggtgctgagcatatcaaacagggagaagggaatttgggtagggcgtgtacagtatccagcaccagcttgctaccctgcttgaccttggaaggtatcagaattcagtggtaatgaggaaccccaatcagaacctttttttttttaaccaggaatctaatagataagatgaagactgtcttataggtattaacctatatttattcttccttgctacttccatttacagggaatacagcggttttggaacctacatctgtagtctcctttaccatccctgaaactccgtcactctcatcaggggtcctcatttgtaaacataccagccaaatcaggtccaaagctctagctaagaaagcattgcatcttttttctgaccctctactccgtttgacagcattccccatattggaaccacatattgatttttttaaatagcttcacacaactacttaaaagtcaaaatatccctggcaaccgaaaaactgacaggccgtgaaatagctgcttaaggacctgtcatccaaactgaactcacctgaaaactgaaaactgattttacacaaacagtaaaatggtttctgtgtatttgtcatttttctaaaagagactgtaaggggtactgagtttagttctgagctgttctgctttagacaagggaccaccttgcaccaggcagttatgaaataagagttgtttcattttcttctcccaaaacacacacactcagtctcctcctcaccccacctgtgccctccactaaaatcactgagaagcttgcccatggcccaccctaacaggtttgcttccccaaatcctaccttccctgtgcttcccacaggtacctcaagcaagcagcacttctcaactggggctgattttgtcccctggaagacatttggcaatatctgaagatatttttggttgtcacagctggggagagggcacaactggtatctactgtgtagagaagcatttttggcctctacatcagttttttaaaaatcagtatttaaggggagacactgttctgtgcactgtctctcccccgcatcagacaaacaaatacatctgtatatgtacaaatgtaaatagcttcacacaagtacttagaagtcaaaatatccctcgcaacccaaactgatgttacacaaacagtaaaatggtttatgtgtatttgtcattttgtacatctccagccccaaatgaatgtcaatagtgctgaggttgagaaaccctgtatatgttggtgtcttagtgtaggtttcgtcaaaaacagaccctgagacaaggatttgagtgcaactagtttatttagaaggtgatccctggaagcactagtagggaagagggtaaatgagagagtgaagggataaacaaaataataataaaatgagagagtgagggggtaacagcaagttacccctatggggacctaggactcattcctgctgaggaactctgggagattgtgtggaacatgccttagagttatcccaaacaaggccatggaagctggaatagttatcttctaattcccctctgtcattagctgaggactacttccaaagatgttaactttctggcacttccggcctgcccttgaagaaccaaaagcaagccctgagatagagagttgtaggtgtttgcagaagaaccttcatgggcatatatgggcatggtgagtgctgaggggttatgaatgccataccaacaatgtctgctggagttggtcctccaagagaacatgtatggggatttatcttcagtttctttttctgaggatgatgccttagccaaaaataaaattctaatcatgcccccagtaggtgtcttgaagacaagcaagagtggcatgttttagagggaccttgttagaacatgcagttagaaaggcccttagaaaccatgtgttccagctctataccaatgcacaaatcccttgaagaacatccccaacaaataaccatctagtcttttcttgaatgcactgaggtacccaggaacacgttaactcaggaagctcacccataccatttttagagggtgtgatgtaggggagccaaacaaatgtgaatttaaacttggttctgccacttaacggctatgcaaccttgtgcaagttactgaacttttttgaatcttactctccttagctataaaataccagcaatattatctacctcttaagattactatgaagattaaataagataatacaaggaatttagctcaacttctgacacatagtaggtgctcaataaatattagctgtcttcacccctttttcttctccaccttcccaaatctcatgtgtcagctctgtacctcataatacttttgatcttttcatttcggttctagcttccagaagaataaaaaataagtccagcccatctttccactaaactaagacttcccccttctccacggaagcatacctggcttactccaccattccttacatggcctggctctgtgggcctctattctctggtctctccccagaaggttttagaatcccctcaaggagacagctgcaatctcatcctgacctgaggcaaaatacacttgtagatcacgtccatttaattttgatgcacatagatcaaaatgagttttgtatgaatagtcttctcttttaacataaagaaaaatctaaaatatggtttaaacttcttatagtcagaaaagagggcaggaagtgattctctctttctttaccatgctctattttaactcttgaaaatgtttcttccatgctgtatttgcctctctccctccatgatgaacagtgctttctgttacttttttcaaaggaaaaatgtaatgtttcatagaaagaaacaagattcatatcctgaatagaggtggcctcatatctcagaagagctggcaagtctgtccttggcagttgccaagaggtgggttggacagatacagcttgagctggaaacaacatccagccttgaaatttgaagtggcaaatttgcaatgccactctctctttccctgcttgaagcccccgattgtactttctggtcatactgaaatctggttggaaaaggaaatcacctgacaggagattttgcttttccttactatagcatgatccaatttttaaaaatgtatgtgtgtgtgtataagtgtatatatatatatatatatatatatatgtatatatgtgtatatatatgtatatatatctgtgtgtgtatatatatatatgatgtgtgtgtgtgtctgtgtgtgtgtataaagatgtgtatactaaaatattaacagtcgtctctatctgtgtgtgaccaagtgtttactttctacttttctgtattatctgattttgggggcaataagcatgtatttaacattgctgcaggaaatcagggggaaaaagacctgtttctattttcaaagaaaagggggaaacttgctgtcctttctcaagtaggtcatatgatttttgcccacaaagcaatgaacagggctcagtgtttgtctcctgaagccagagctagcttgctgaaaggcatcctttagcctcatgggcaccaagctattttgcatgaaaaaattaaaattcaggaacatagagggctttctcatccattcttcctcccttactcctctgggacttcactggcaacccttctactccctaccagccaccaacaacttgaggttcagtctgaggactgagaagaaaagagaatccctcctgggactgagttggcctctaggacaggaatgttgctttatacttcttccatattccctgctgggtctggcaccatgattgacagaaaaaataactgatgctcagagtaatggaacctcaaaggtcatcagtgcttaataatttcctaatgaacagattaaatgtggctactggtcactttacctgcttaagaggtttaagccacagagtcaggtgcctcaattcatccagagaccatccccagccagttcccattctcagtgtcaaggaatacaaagacatgactgagcatttatgcctctatgagtgggacaggagaaggggccatgacccatggtgggactagcaccaacaggtctgttttacagcattcagggctgatgatagctgcatgcctggcattcatacaaatctgccctcccacagtgttcttgccccttccttggggtgtatggacatggctgccggccaaaacacagctctgttcaccaattcaagataaggaaatatctatctgggcctgactttctatataagtaccagatggtaatgattaaaattaatttaaattaatgtttgacagtccatgaagggcataaattgcatagtgtgctgcttgtccaatctgtcatcttgtttccctcggctcaggtcaacaaacaacagctgaaagcgccatctctgagtcaaacagtagcttatttctctgctgtggaaatggctgctcagtttactaagttgaaggcttccatgctgccaaaattgtgattaagatgccttaaaaggcagagaattctatctttttgccacaatctccagcaatcatctcccaaacacagtaatagcaattactggttagagttcagaaactgggaaatctgaacctggcctaagagtgaaacattgccaaaatcacaatgcaattttcagctctaatgacagccttcttcattcacatggtttctagaatgtgtgggcagtgctgatgtgttatcaagttgcaaaagaattcatggcatcacattttaaaatcatccatctgccaagtactcccttcctaaaaacttttcagatttagatttttgctcctttcccctgtgttgttcaggaatcagtgtccaatatttactttttagtacttaaaccccaaataacgtttcaacttttgcccttttacacaagaactttgatgaaattttcaaaatgtccagcataacttctttggtgggaaagattggattcttcaggagcaagccaaatagtagaacaagctactgaagacaggcacagggtgctggaagttgtaccacccagattgcccttcaggaatgaaacacttctttccccagctgctaggagagctgcaggggtatggccatccactgtcagctccctttggagattgcctccactgaagaaaactgccctacccaagatttcttctccttctaaaggcagcccacatcactcaacttggggcaactctgaagggccatccctgcctttctggttattttctctacccgggcttgtctcccagattactgcctgaattcctcccaacttcattcaggtctctgctcaaatgttgcctcatcagaaaggctttttcctcatctctttttttaaaataacacacactcagccctttcccatagccccagctccagggctccctgtgctcttaccctgccttcatttctcttaccactacctgccattatttacacatttatcaattattttgtttagtgcctgtctccccactagcatataagctatatgatggttgagaatttggctgttttgttcattgctttatctctactacccagaaaaatgcttagcacatatgtagagattctcgataaatatttgtgaatgagtacatgaatgagtgattagttgcctactatcttaggtacttcctactgcttaggctgcctagctctctcactgcacatcctgggaatcagagtcctgccaaggtagcataatagtcaagaacataggctatggagttcgactggcctattcacttagttcataaacaattatatagttcttaagttgtgctaggcattgctcttggctcttatgctattaatacatttaatgtgcataacagccgtaagaggtaggtgttattcccattttaaaggtgaagaaactgaggaacagaggcgttaagtaatttgctccatgtcatacatctagtaagcgacagaattcaaatgcaggcagtctgcctccagaatctctgccacttaccagctgtataattttgagtaatctcctctctgaactggtttatttgcccatacacatgaaaataataatacatactacacaaaattgtaagcagttttaaatgagatggtatgtgtaaaatacttagcagggatccttatctacacaagcacttaacaaggggcagttgctatcatttgtatcccagtgctttgccttcccctacatcccaatagactgcatggacttccaactattaccccatgtttcatattagatgccctgtcttgactgcttgacactttctgaaggccttgaatggcaaacccacccaccattctgatgttccatgcacaacccagccttgtgtcacctccactcttgactccaatctagctttgccctaccgctgtagacagagctggggccaggtcaagaactcttcaagtctgccgttccctgtcaggtcttgaaataaaatgtatcttagaggcataagcaacaaaattcaagtgacatgacttgcctttgataactagcgctgcagttcctagttcccattacccagcataatcactcagataagccacagcccaaattttaccaggtgttctggccactctggtgcactgtccagatccctcttcaatgaggttcttgttgtctccggtgctaggagcactgatggcagacagcccttagctctaagcttcttcagggattgcctcagctgaagtgaaccactgtgaccaagaggtagtttccttgataaccttctggggttgtccatatccaatgacctaccaatgcaggaatagaaattcccagccaccttgctgctgggataattggcaagccacatgtaggagaatgaaactggatcctcgtctctcaccttatacaaaaatcaactcaagatagatcaaggacttagatctgagacctgaaactataaaaattctggaagataacattataaaaacccttctagacattggtttaggcaagtatttcatgaccaagaacccaaaagcaaatgcaataaaaacaaagataaatagctgggacttaattaaactaaagagctttttcatggcaaaagaaaaagtcagcaaagtaaacagagaatgcacagagcggtagaaaatcttcaccatctatacatctgacaaaggactaatatctagaatctacaatgaactcaaacaaattagcaagaataaaacaaaaaatcccatcaaaaagtgggctaaggacatgaatagagagttctccacagaagatatacacatggtcaacaaacatgaaaaaatgctcaacatcactaataatcagggaaatgcaaatcaaaatcaccatgcaataccaccttactcctgcaagaatggccataatcaaaaaatcaaaaaatattagatgttgatgtggatgtggtgaaaagggaagacttctacactgctggtgggaatgtaaactagtacaatcactatggaaaacagtgtggagattccttaactaaaaatagaactaccattcgatccagtgatcccactattgggtatctacccaggggaaaattagtcattttcggaaaaagacacttgcacacgcatgtttacagcagcacaatttgcaattgcaaaaatgtggaaccagcccaaatgcccatcaatcaacgagtggataaagaaaattatatatatatatatatatatatatatatatatatatatatatatgatggaatactactcagccatgaaatggaatgaattaatggcattttcagcaacctggatgggattggagactattattctaagtgaagtaactgaggaatggaaaaccaaacattgcatgttctcactcataagtgggagctaagctgcgaggatacaaaggcaaaagaatgacacaatggactttggggacttagggggaaagagtgggaagggagtgaggaataaaaggccagaaattggagggctgggcgcaggggctcacgcctgtaatcccaacactttgggagaccgaggtgggcagatcacttaaggtcaggagttcgagaccaccctggccaacacggtgaaacccaatctctactaaaaatacaaaaattagccaggtgtggctggtggcaagctacctgggaggctgaggcaggagaattgcttgaacccaggaggcggaggttgcagtgagctgagatcatgccactgcactccagcctgggtgacagagcaagactcagtctcaaaaaaaaaaaaaaaaaaagactacaaagtgggttcagtgtatactgctcaggtgatgggtgcaccaaaatctcagagatcaccactaaaggacttactcatgtaaccaaataccacctgttccccaaaaacctatagaaataaaaaattaaaaaaaaaattcccagccaccttggcccaactgagggcaattctgaaaggccattttaacttcagagctaccttgggggtctgcctaggctgttgttgggcctgcatcacagtttatcttctccctctacctgcttctgcttttttcccctcctttccccagatattggtcccaagggtgcaccctaatgaacatcctgtctcctatgctccatctcagagtggacttcccagaataaaagcctagcctataacacgtggtccagcccaattcactgacacttgttgcaaggtcgcaggattcctctagaaactactaagcccaggtgacaaaatggcttcccaggattatgactccctggttgcttccccaattcatcctgtcattttttaccccttctcagaggcatgactagtctagcctagctgcttacacaaagcagccagaaaaaaatgatgcctattaatcagttcttgcctcctgctgatcacctcagctcagggcttctctttcctcaaggaagtaagacagatgatcatgggttgccacaaaatgctggttctttactttgacctcctcagtcctgggaggatttatcagccaacaacaagctcatttaactacacgtcagaagcagacgaagagtcactcattaagtgactataaacaactaggtgcttcacacgtttggtaaaggcccatatatttataaatatgcctttgggcatatttatatgcccaaagcctcagtgatactcactttgggaataacaaatcccaaaccacttatttgttatgaaaataaatgacattttgatctcagtaatcatttaaaattctgtccttttaatggcccataaaatcttaacatactcccttgcatgtcagatttcctaaactacagctggatcaacctcataacttccacttggtcatcaagaatagataaaatggctgggcgcagcagctcacacctgtaatcccaacactttgggaggccgaggtgggcggatcacctgaggtcaggagtttgagaccagcctggccaacatggtgaaaccccatctctactaaaaatacaaaaaaaaaaaaattagctgggcgtggtggtgggcacctgtaatcccagctactagggaagctgaggcaagagaattgtttgaacccgggaggcggagtttgcagtgagcaaacatggtgccactgccctccagcctgggcaacagagtgggactccatctcaaaataaataaataaataaataaataaataaataaataaataattgccttatttaagtgtgcagtactgtgtgctggataaactaataaaatcttagaagataaaaatgcagcagagcataactgcttatttttcagatttactaaggaaagatactttatctaattaagtagatcttcttaagcaaatcctttgctgtcacagcatgtagcctagttcttataaaggaatgaaaggaacacttgatagtctattggtttctcatattcgttttagtttttttaatgtacttttagaaatactgtttcatttctgatcttagattgtctggctacccaaattggagctggtattgttaggcaggcctgagtcctgatcaatattccattctttatagtgaaagatgatataattgatgcggatcccaatctgaatggacaatcacagctgtgaaaacagatgctagactcccaggcccatcccagccatacatttctattcatggtgcagggcacttggcagagatgggcattttgtgtcagtaagcctctgatacccctgggctgtctgaagattatttttaaaaagttatgattcactgctgatagggctagctgcctcctaggattctacaactcctatggcacctgtttgagagttttcatctgtgcttcagatacctacagtcacctcatttcaggccccctatgttacttggatcacaggaacaatgaatcgataagggcttcattaaaatattctgtataaaacattttatggttgtgaacatcacaataggggaaattaccgcagtttaacatctgcccataggagcttcagacttagttgaggaaacacaattaaagcagaataacgtttgccatcattgaaataggttgtatgaccacctccataatctcaaagtgaatcacaggggtccttgttaaaatgcagctctcatagcccatctactgaataagaatctctggattggtgatggaatctgcatctttaacaagctccctaagtaattctcatgcacacttaatgttcaaaatcattaccctagaggctgattatttcagcgcaggcatggttcctgcaatgccacaactagttagtgattctctctgtgttttggaaggaaatagcagcattcagtgacgatcaccactgaaatgtgtgattagtcattataatgatggtgttgatgcctcacccagagcatccatccccagctgcttacaccatcttacccagcactgtgactagctctatttattttatatttagtagctatgagtgttggctgctaacagctcacagctgcactgttctcttgagaattactctcagctgatgggaacttcacccagagatgcctaagaggttatgtacccaccagcacagtcaatgacaaactggtatgtaggagcaaaaatccagtccctttgcctccaaggagacaactgtgtggtgccgtctttgctctagaacttcctgtgggatcaggctgatgctagacctctgctgaaaccatatctttgcttagcctcttcccctgcctttcctgcttccctcacttccttccttacaggtttctcctgagaacatttcaaaaaataagtgttggagaggatgtggagaaagacgttcacttacacactgttggtggaaaaataaattggtatagctattatggaaaacagtatggaggtttctctgaaaactacaaatatagaactaccatatgatccagcaatcccacttctgggtagacatccaaaggaaatgaaatcagcacattaaagagatcctgcatgcacatgttcattgcagcattattcacaatatccaaggtatggaaccaacctaagtgtccatcagtggatgaatagataaatacacacacacacacacacacacacacacacacacacaaacacacacaatggaatactattcagacttgaaaaagaagatcttgccttttgtgacaacgtggacatggatgaatatggagaacatcatgctaagtgaaataagccaggcatagaaagaaaaatactgtgtgatctcacttgcatatggaatcttaaaaaagtcaaatcctgttcatagaaacaaagagtagaacagtggttaccagggcataggagggtgggaaatagggagatgtcggtcaaggatacaaagatgtagttttgtaggattaataagtctcgagatctaatgtacagcatgaagactatacttaatattgtataatggaaatttgttaagaaagtagattttaggtgctcttaccattaaaaaaatggtaactgtgagataatggatatgttgacttgatagatatattaaccatttcattatgtgtatttatagcaaaacatcgtgttttagaggctttttctagggggaatgtgttataaaaataacaaaagtaactgtgataaatacagagatatatttgtagcaggatataaaagaaataggaggttctggttccatgtaaaatgggggtaactccaccctgtttctcccactcaatgcagctacaaaacctggacagaatgcacggggcagctatttgaggactccaaaaattaaacagtagtgggcagactaggagagaagacaggccagaatctgaagtactaccaaattgacactgagtttatcacttatttttcttctgttgtccccgacctagaatcaaggcatcctgaaacatagaaatgggtactcaggcaccgacagaaaagctctctaattctgtcttgaagagcaagaaagagatctcctgatgctcagagagagggtggttgggggaagttctctgagatgtttcccttttctctgtgcttctgcactccaggacatcctgcagtaactacagtagcagtagagacagcagcagcactgggggcctacggatgcctaaaattctgagggaggagaaccactgtttctgatcaggatagttatgttccaaaagggtggggtgaatccccattgccttttttctttctatctgccctcctgctgtttcagttcaggactgacataggttcagttgttggaagtgcacagcacagcatagttatataaagccccatctttcttagactgtaagagggtcacagcctgtaagttgagccccagggaagaaaaagtaatggggacattttggaaagtatgaggaaaacaaccccataaaattgtgaagtcctaggctccctccctagttatgcatgtatggatctcacacaaaacaatataccaaagattttgagaatgaaattatgggacaggacactgcttaggttctaaattggctgtgggtttcacgcatatgagacagacctgaatagcactgcaaaagctttggaaactgaactgacattggaaccacaattcaaagaaggctggttggaatgtacagcctgaacccaatcaagttgattgcctatcacagcaaaatgaactacattccctacaggatgaaagacacagagtctcataacctagagtcttccaaaatgtccaggataaaatccaaaattactcagcatagagagaaccacaaaaaaagctcaactctcatgggaaaaacaaccaacagaaacaaacgccaagatgacacagacactggaattatcagagactttaaagcactaataattaaagagtataattggtttgtttgtaacaaaaagaaaggataaatgcttgaggtgatggataccccatttacccagatagaattgttacacattgtatgcctgtatcaaaatatctcatgtaccctataaatatatatacctactgtgtacccacaaacattttttaaaaatttaaaaagaagagaaaatactctcaaaataaatgagaagacagaaagtctcagcaaagaaataaaggatataaagaggaataaaatgaaaaatttagaaatgaaaaatacaatgatcaaaataaaaactcacaagatgggctcaatacaaaaacagagataacagaggaaatagtgaacttgttgggagatcaatagaaatgatcctatccaaataatagagacgaaaaaatatttttataaataacaaacagagcctcagggtcctgtaggacaatactaaaagagctaacatttgtgtcattggagcctcaaaagaaaatgagaaagaatatgctgcagaaaaaatacgtaagaaagtaatggctgaaaacctcccaaatttggcaaaagacataaacctacagacttcagaagctcagcaaatttcaaataggataaccctgaaaaaaatctgtgcctagaaacaccataatcaaacatctgaaaactaaagacaaagaaaaaatcttgagagccaccagagaaaatgacacatgacttacatgataataacaatttgaatatcagcaaatttctcatcagaaaccatggaaaccagaaggaagtgaaatgccttttttttgaagtgctgaaagaaaagaattgtcaatccagtccttcagtaatgagggtaaaataaagacattatcagattaactaaaaccaagaaaatttattgccaggagatgttttctgaaagaattgttaaagaaaattcttcagacagatgggaaatgtcaccagagagaaagttgcaacatcaggaatgaaagaaaagcaatagaaatggtagacatctgggtaaatggaatattatttcctcttgagttctttaaaatatgcctgatgattgaaagccaaacataacattttgtgatagggttttcaatatatgtagaggtactacataaaaggcatttacagtataaagggggtaggggaaagggacctatatggtggtaatttttttcacttgaaatagtaaaatatcgatttagagtagactcagaaaagttcagtgcatatattataatccctagaaaaaacacaaaaaaatagtgtttgtagtgttttccttttctctgatcagtaaaaaacaaacacaataaaagtaaaaataaataaataaaaaggcagtaaaaatacaatagacaaattaaaatggaatattaaaatatgtccaaataatccaaaaagggaagaaaaagaaaaacaaagaaatgaaaaatagaacaatcacaaaataaataataaaatagtaagtataaatctaaacatatcaataatcacattaaatggaaacgtaaaagtcaaaaattgtcagaatggatttttttgaaaaagacccaattatacactgtctataagagactgacttcaaatataatgatataggtatgttaaagggatgaaaaaagatatattaataccatgccaatactaataaaaacaaagctggagtgactatatttaaagaacagatactggcaaagtggcatgctgctgaatctaagctacatgtcaccaataattacttaataactcttttatttacattctttcccagaaaagttttacctcatctcacttatagaccttccagacatccagatactaaaaagcttcctagcactagctagacaattttttgtgaaatgttcacaggttttgaattagaatcttccagactattctatctaatggcttaccttaagaacataagacataacatccttctcaactctgttaggtgagcgacagttttccaggtagatttctgtttcctataaaaaaaaatgttattttctcattttcattttacaatgataattacacctacctgatatggctgtacatactaaaatgagataccttatgatacatgtttagcacagtgcttgccacatagtgggtacacaatgaacatagtttcattcctcttcatttgcatgccttagagttatgtttgctaagtaaattgagagtaaggtctgaagtctcagataaggttttataatgggtatgtaatgatcttggcctcgaggagaagccaaggattggatggaaagtaaaaaagaagaaagacctcccaggcaggccctagtaataagatagcatgaaggtaatctttgaagtcccaggcagccaaaggtaggattaatgagtaaagaacacttgacaagtagtagggatattgatttggaatgtagccttaaggaaacacaatgaaaaaagtcttacatttgtggatttgagttgacttcaggctagcccatggccacatggagaaatacgcaatatttttctttggtgcttttccattacttatttttgctgtcatttctatcctttcagcatctctttcaaggactctagtgtactacttatgctcacttatttgggaggaaagtgggatgaaaaatatctaatttatactaaggagtttttgacctaatggattaacccttctaaatcatcatcagtttaaaagagaaccttggtttgccttgtgattaatcaagagaaaagactcttcagtgattcaatttccagcacttctaagtaaggaagattttttttttatcagaaaggctatcaactcaaatcataacaaaaagaaaactacccacttcatttatgggtgggaagaacccaaatttatagatctagacatgcacagtccagatataatcatgctttagtgtcaacattttaaatgaggctttggaagactttgcctcaattcctcctatacaggtgttactgctgagcaatagggagaagcacttcagggattcctggctgatacaaagaaatggagaagtaggcaaatgaggaaagtcaacacccaagataacagtaccgtattaaattcaaagggccagaggcatgattgccaaccatccttcatgtttgaacttaggagaagatgaagttcaaactaagaaattgttaggagcaactgttaagtccaaggtggttatggtgaccagtccatccatgacatctgcagcttatgtttcctcagtgactgccagttgtaactagcttcaaaggttaaaaaaagagcaagtgtagcaaatgcagcaatagacttctgatgctatagggaaagtttaaataaatattagagcagaattggtagctattagaacactgaagttatgaagctagtagaatacagaagttatgacacatgctaccacaggaggtagtaaaatcactatttaaagactcattagacactcatttttaagacaggatttaagaaaaataatgagatctatcttgtggtagtcctgagatatgagctaaataacccacgagaggtcccttcaaatccaagcaattctgtttaaacgttaaaacccatctgctagaatggaaattaaatccgataagcattttccttagaaaaacattgctttgtatgagcaatggtctgtttgctcttctctttctctcttttcatcccttccaaattaaaaactggctcaaacctatctcaaaagtaattttcttgatattaacccctaacaataggattcatatcataatataccaagaatgtccaataggctacatcttgataaaggattcctgaactttgtattgggaaatattctgaagctgcatttagagagctatggcttattagcaatgcctgccctgtgcaggaagggggattagagcatgcttaccaggtgtttgttactctgcctatataacaaacaacccaaggagtattgataattaaaagcaataaacagtcaatctaatattttaatattctgaggcatatatgatctcatgggcatcaatgagatttgatgcatggtataatggactccttctgagaatatggaaataagaggctagtcattgtttaaaacaaagagattcaatagaagaggaaaagatgtaacactggtacactaggaatagataaaccttttttgcaagtctactattctaaggttggaaccctaaggaaaacgtttaggtataatttaaaggagaaaggaaacagaactcatattgctattgccatatactacactgcacggcctaatggaggacacatggtattcttctaatattgattacaaaactgattttaaaggcatagatagagctgaacttgaatcatcatccatttgaaaagccatgccattaaccacaaagctatactgcctaaaccttagctgggactctgacctctcaatgcttaataacttttatttcttttgatagcctggtctacacagatatctaaaggccttcaaggttcacaaggtaaatcttgctgataaaatcacattggtttcctgaaaaagtttttcaggggattcaacccagaatgtctcaagcctggagtcagcaacgatatcttcgctcttccatttaaagttgtgaagatctattttgtggttctggtggttgtggtaatgtggaagaccctagtagagcacactcctccagcctcctatctgctttatctgagacaagtcaagtgtgtgtggcagttggggatgaagtgaggagagttgaggggatgttgcctgacatgttgttggaactcaaaaatttatcaaaagaataaatagttgaatgaatgagtggaagtattgagaccaccttaaatagtggaaagaaacgtgcctgctggccgtagaacaatagacatgacaagccagaaaaacagaagcaggctagtgtagataagattagtactttcctactttactatcagcaaccatcctcctaagaccagaaaactgggacagttttgcttaggaggcatgtatgtctgtgggataatgccaagacagaaaggctaacccttcaaattagtagagggcagtttatgtgggcatgatgacatttggcagcacttaatttcggcattctctagcatgtacagcatggaataagagggtcatatagaagaccatttaagtgtacagtttgttctaactgtgaatctgggcttggacaaatagactttcttctttttaataatacactggtatgtttggagataaacaacatctaaaacttatgaacctttaacaattttattggaggaaacaattgtggttagttttagtgatcaaagaaaaacttgaaatcattttggaataagaaattgattttgtttttaattggctattttctgaatttctcattttggattttaagctgtgctgctgttcttttaaagaaagaaagtgcttgatggtgtttgaacatctaagtaaattagggtataaggctgtatgaatttgggtatgtttaagcttcattttaaaagtggctgtgcaaaaacaaaaattgacaaatgggacttaattaaactaaacagcttctgcacagcaaaagaaactatgaacagagcaaacagacaacatacagaataagagaaaatatttgcaaactatgcatctaacaaaggtctaatatcctcaacctataaggaacttaaatttaaaagcaaaaaacaaccccattcaaaagtgggcaaaggacataaacaggcccttctgaaaagaagacatacacgtggccaacaaacatattttaaaaatgcttaatgtcactaatcattagagaaatgcaaatcaaaaccacaatgggataccatctcacaccagtcagaatggctattattaaaaagtcaaaaaagaacagactgctgaggttgtggaggaaagagaatgcttatacactgctagtcggaatgtaagttagttcaattgttgtggaaagcagtttggcaatttctcaaaggatgtagaactaccatttcacccagcaatcccattattgggtatatacccagaggaatataaattgttctaccataaagtcacatgcacacatatattcattgcagcactatctacaatagcaaatacagggaatcaacctaaatgctcatcaatggtacactggataaagaaaatgtacatatacaccatggaatactatgcagccataaaaaagaatcaggtcatgtcctttgtagcaacatggatggagctgaaggccattatcctaagcgaactaatacaggaacagaaaaccaaataccacatgttctcatttataaatgggatctaaacaatgagcacatatggtcacaaagaagggaacattagacaccagagcctacttgagggtggagggtaggaggaggataagaataaaaaaactacctattgggtactatgcttattacctgggtgatgaaataatctgtaccctaaaccccagcaataagcaatatacctatataacaaacctgcatatgcacccctgaacctaaaagttaaaaaaaataaatgaattagtaaaagaaagtggctgcacagaggatatacagtcttgggaatgactggtgtctagaatctgctaccagaataagttttgcctcggtgaatactgattttgctttgcatttatttagacaatgcttctgccttttatgttttatcgttttcagttattcacaagcataatattatgaaattaaatctataacaataatctccatttgggttttgatatcattctaattgaaatagctcactatccacttggtgaagttatgcagaagataaagacattctcagctccaacttactcattatcatggattgttgttgattaagaaaaggtactttatactaccagccatccttcacagaggctctatataacttgttatactgcttaattcaatccataattgagaaataggcagaaatatttaattcactctgtggtcttgggcccagaatacaactgagttttctcgggaattagaaaaactaggaatttgtaaaatgcatgttttcatgtttaattaggggaaatatgtaattatgtctttttgagctgagaatgaattttcatagaactcataattcctgggtattctccatttatggcaaggcagactattaagtgctgggaaattaaagctgtccaagagcagccctcctccaatgagggatgaaaattgattggataagtaccccagctctcaagctcctcagatgggataactctaaggtgcatgttctacattacaggacagcaaactatttctgttaggggacagatactaaatattttaggccttgctagtgacatcatctctattacaattactcaactctgctgtacagagattacagcaatgtacagagttgtaattttgtacaacaaaactagccataaatgatttgtaaataaatgagcatggctgcatttcaacaaaactttatttatgaatactaaaatttgattttttggaggtaatttacatatcacaaatttcttcttttgatattctttaaccattaaaaccataaaaatcattcttagcttacaagctatacaaaacgaggctagatttggcccatggattgtagtttgccaacccgtgttctatattatctcttgaagtttctctggagattatacagtggtatcttcagtggtatcttgctggagaacttggtattgttttcctttttttttttttttttttttttgagacaaggtcttgctctgccacccaggctggactgcagtggcatgatcatggctcactatagccttgacttcccaggctcaggtgattctcccaccccagcctcccgagtagctgggattataggcacgtgccagcacacctggctaatttttgtattttttgtagagacagggttttgccatgtcgcccaggctggtctataactcctgggctcaagtgatccacctgccttggtctccctaagtactgagattacaggcatgaaccaccaaacccagcccattttcctcttcttacctgtctcacttccccattcacctaacagtgttccctggaatcacctcccaaacaagctacatgcatttgaatacttgtcttgcggtttccttcttggggaaacaaaactaagaactgggctgattaatcactgaattgaatatttgttgctcggcatcatgaagaccacaggaaagagtcctagaattctaagaacagatgcaattaaaggctctttccagtacagtcatgagtggcttaatgatggggatacgttctgagaaatgcagtgtcagtagattttgtccttgtgtgaacatcatagagtgttcttacacaaacctagatgacatagcctactacacacgaggccatgtgatatggcctatggcttctaggctacaaacctgtacagcatgtgactgtactgaatactgtaggcaactataacacaaaggtaagtatttatgtatctacacataggaaaggtacaacaaaaatatggtataaaaatggtacacctgtataggatacttaaccataaacggagcttacaggactggacattgctctgggtgagtcagtgagtgagtagtgagtgaatgtgaaggcctaggacattactgtgcattactgtagatattataaacactgtacacttagactgcaacaaatttataaaaatatttttctttcttcaataataaattaaccttagcttaccgtaacctttttactttataaacttaaaaaatttttaatttttttactgttttgtaataacagtgtaagatacactttatatagctgtacaaagataactttctttatatccttattctataagcttttttctatttctaaaattatttctttttttactttttaaactttttgttaaaaacaaaaatacaatcacacacattagccaaggcttacatagggtcaggatcatcaatgttcccatcttccacctccacatcttgtcccactggaaggtcttcaggggcaaaaacatgcacagagctgtcatctcctatgataacaatgccttctggaatacctcctgaaggacctgcctgaggctgtcttacagttaacttttttttttatcagtagtaggagtacattctaaaataaagataaaagtacagtacagtaaatatataaaccagttacagtgatttattatcatatttaagtattatgtaccctacataattgtatgtgctatacttttatatgactggcagtacagtaggttgtctaaaccagcatcaccacaatgatgtaatgcattgtactatgacattatgatggctacaatgtcactaggcacacatcataggaatttttcagctcctttataatcttatgggaccactgtcatatatgtggtccatggttgactgaaagataatttcaagagtcagtgacataattgcccattgaagttatgtggtccatgacttatattctcagactcgttgtgtagtgggttaaaggaataacctttatcattgcaatcttctgacttgcacctgaggtaaaactgggagtgttaatacctgcaatgagcccaaggcagccatttcatcttcttggatccatcactcccgactctcatgctgggtttatcagcagtgaggacctaaaggttcctcacagcagcaggtgccggtgactcagagtcaacagagtcgtgtaacagtctgcaggaatccaggggcattaggcatgatgataactattgcagcaatctctgtagccacagggatttatgaaatgtgttttcttcccaaagctccctgcaaataaccaaagcattgaattatctctagatcaagaacagcaggtggttagacaggacattcattttttggttccatctcactcattttatgtagtaattgctttctctgcaaattgaaaaagctttcctcgccccgttctctgctgttccagatggctgtaccctctcaacctggcaggtgcctgcctgcctgttggcagtgaggctgtgaacttactaagtgcagcattttccaatctccagacacaaatgaagtgatgttgattctctactaatgtcaggcttctctgaggaaaggataggccatgacatgtggactacaagaaattatgaagctatttcaggctctaaagtactagagacttgtgcatggtttaataaaaaccgatttcctctagtcctacttattattcaacatacaacaaaaacataattgtaaacttaaaagtaaaaaaagctgacaacccagaaccagctctggggtatttacaagttctaacaaaatccctccaaaatgtgttttaattgggcttctattagcaagtctaatccactgggactccctaattactaaggtaagtcttaactccctttcatcattattctctctttcagtccaaaatagaaagaaataaatccttcttaagatcaaattttaacttgaatttgagtccagcaaagtaagctatcactggttgtttttgagcctaaccctctagagagcttcattttaaaattcaaatacaaggagattatttatcagtgtggttctggcagtgacataattgccccttgaagtaaacaagttggcagccttgcaaaagaggaagtgattgttatttatttatttattttgtatgggaattaggttctgcaaacaaatccctttgactactgaggcttaaaaaatgctgtatggtgttcaagtgaaaaagcaacatgaagccagtgaatggccatggtcacagggtgggaagtgaagccatagtaataaaaaccaaagtgccaggaagtggcaaaccaatgcccagagctataagcctgctgaaatttctagtctaggttccacattccttcttgaaaaataccttcctcttgatcagacacacaaaggtctgtgtttctgtggtgttatagcatgcagctgggatagagtagggtgagaactggctcaggcatgggacatccaggttatcttcctgcctgtaatagtctctgggaccatatgctgcaagctgaggcagaggagagagaagagctatttcttaccatcatttagctgccaagtcctggcatgctttcaccaaattacataactagagacagcaggtgtgtttcagaagcacatggaccatcaccccacctccccaacacacacacacacacacacacacatacacccctcacctagatctctctccaggtccaccccatcaactatgttcccatctgcttattaatgctggaaaattcacagctagtgtttcattccttggatgtaagcctctggtttttagtaatgtgcatataatcctgggatatatgacatctgaatcccttcactttttaattcaaacaaaccgacaatgtttgctgtaaataactcattcaaaatgctcacaaaattaaagggataagctctattaatcacatctactttactgtatacatgtcgagggagggtgaggcaaagaatgatgcaggaagaggaggctgtgtgatctacctaatgatcaggttgacagaaataaaaactaccattattttagccaactcaacctctaattgccataaacaagattctacacaggtgttcattctttatactttccaagccttactcttttctatgaatgatatgtataatagaataaaattttaaaatgaaattcagatcaaataccctgtttggggacctggaaataaaattcatcagaaaactctatgtgattgtatctgtttggccaacagagatattgttatatggcatttctccaagttcccactcttatttatatcactttcctatcctcataacatctgtgcttttaggagtgtagtaatatacttaactgaatacatttctgcttagccaggaggagatgcataaagatgtggaaatacagaaattgcgatatcatgatagcatagggaaagaggaacactcataaacagagcaaaagttggtggaaaaatgtggccattttatcaaaatgtattatgtgatataatttaatgtagtagtacttttcccagaaacttcattgtataaaagcaccttaacaaacaagtggactgaggtacaagatatatacaagatacaaaaatattcattgtaacattgcaaatgtggcaaatgctggaaacatcctaagtgctcattagtaggttaaataaattatgatttatttacatgatggaatctaaagccactaaaatatttaaataagtggataaaatacctaagatattttattaactgtatgtgtatggtcatacataatttttttacaagtaaaaatgggcatgcacattttcctgtgattacctgtaagaagagggatgttggcaggggaaaaaacttacttttaatttcacggtcttctgaacctttaaattttcttgttgcaagtgatcattcattacttatatgagataataataagaaaataaagaaaaacaaaaaatgggaaaaggagaaaagcaaattgcccttctggaagcatatctaggtgtcattttggcctacattctctcttggagagtggcaatactgggttagaagagatcagcactgtcttccctgatgtgccctgaacatcactgtccctgcatgttttatatattcgtcaccataaactaatatctatcttatttggatcaatgtaaacagctcatagtacctcttggggtaacaaatttcataagtttatcaccctgacttcacagctatcagtgtgcagagaagactatgactctaaacttagtcccttcaatctttaagagctgttttccaggtgcaggattataaaggcttgatgagtaagtcagtgatcatccctctatgtctttcagaaatgtgtagtctttgactctgttactcagctttgcttttccaagcagaagtatcacaaatcttccatctgccttcaaagagagagatcaccagtttgtccaatctattagctgcccttctctgggaactttccacctccaatatgaatttttttagagattttagaatcagaattgcaaatgtttttcccagcatagttgggcagggattttatacaatgttcgctgttttgtttccactgccttttttcttgacaagtccaactgcttggccagctttttggaacaagttatccaactccttttagccattcttttccctctgcaagacaccaaaacctccagataaaaatgaaaaatgttcagatgtgtctaaatcattgaatcccagaatagaactcaaagggtcattagatataatctagtccaaacctcctattttataaatgggagaaactggctgggtgctcatgccagccaaggtgggagggtcacttgaggccaagagctcaagactggcctgggcaacatagcaaaactctgtctttactaaaaaaaattttttaattagctgggcatggtgttgtgtcccctgtagtcccagctactcaggaggatgaggtgggaggattgcttgagcccaggagattgaagctgcagtgagctatgatcattgccatcagcctgggtgacacagcaagaccctgtctctaaaaaatatatattctttttctttttcttttcttttttctttttcttttctttttttctttttttttgttggcagagtcttgctctgtcgcctgggctagagtgcagtggcacaatcttggctcattgcccctccacctcctgggttcaagcaattctcaaacctcagcctcccaagtagctgggattacaggcatgggccaccacgcccagcttatttttgtatttttagtagagacagggtttcaccatgttgtccgggatggtctcgaattcctggcctcaagtgatctgcctgcctcagtctcccaaagtgctgggattacaggtgtgagccaccacacccagccaaataattttttaaataaataagtaaatgggagaaactgaggttcagagaggtcatattagtccattttcccgctgctgataaagacatacctgagactgggaagaaaaagaggtttaattgggcttacacttccacatggctggggaggcctgagaatcatggagggaggcaaaaggtacttcttacatggtggcagcaagagaaactgaggaggaggcaaaaacagaaacccctgataagcccatcagatctcgtgagacttattcactatcacgagattagcacaagaaagaccagcacccatgattcaattacctcactctgggtcctgcccacaacatgtgggaattctgggagatacaattcaagttgaaatttgaatggagacagagtcaaaccatatcagaggttaatcaaggactctaacttaaatctcccaacttccatgccagccccttctccaccacatttgtgtacaagagatagccaaaatatttaatacctgtatatggcacaggcactggactgaagacccacctgagtatcggggcagggtcctgaaggcagcccaatgtggtgggcaatagctctttattttctgggtcaaagagtgttctgtggggtcctgggggaggagcagaggtggtttcagtgccaggtggagggagagtgttgtggagctcggtgcaacgtctcttgaccaacaagtatggaagtatttaaatatattaacaactgggacagtcgtcctagtgtgtcccaggtgtgcagcagttgcattggtctaatttagataaaacttaggtgtacattttttcttcatttgtatactttgatgtgtgaagactcagaagctctggccaagtgatgtgctttaaatctttcaatatttagacatcataaaaatgctaagtgctctggacattacacataattaaacaaagtcctaggggtcttacaggcttttaatatcagtcatgaaaatgaactcttttttttttttttttgagatggagtctcgctctgttacctgggctggagtgcagtggcatgatatcggcttaccataatttccacctccccggttcaagcaattctcctgtctcagcctcccaagtagctggggcctcccaagtagatgggactacaggcgtgcaccaccatgcccagctaatttttgtatttttagtagagatggggtttcaccatgttagccaggctggtctcgaactcctgacctcaagtaatccccccgccttggcctcccaaagtgctgggattacaggcgtgagccactgtgcccagccgaaaatgaaatctttaaattgcaaaatagatgtagctacacagaaatatgaactctctaaaaatgcatgagctgctgcttatccatcttcaaggaaaaatgagtcacagtaatgtttccctctgtgaaacagattttaaattgtgatttatgcagtttaaaagcagctaagtagcctgtgtcagtaagactatcatgagatggtttgatggagactattttggataaattaccaaatcaactcaattccccttcctcagagccaaagagtaaagaatacccaggaatggctgtgtgtgtgtgtgtgtgtgtgtgtgtgtgtgtgtgggtgggtgtgtgtgtgtgggtgtgtgtgaagaggttctttgttctcttgttgttttcctctctccagcccctcaggaggtgctacaaagacacagcatacgtgaaagctaaacaacagcatgtacataaatattcctcctcctcccctgcctaaaaccaaaacatctatctcacagcttgaaatcccagcatttcatctggcctttaaaagtccccaaataaaacaaaattattcctgaaaagtcttgaatacttgaatctcttttccaccacagaaaaatggggtttagtttcccacaaaaaaatattttctcatctatttatttaacagatctttcaaaaatatcaaaagttaaatcacactttgtcccacttttaaagaaattgccttattgaaaataaagactatataatagagatatagaagaggcttaaatatatattgaatgtgggatgaatgaaaaaattaatcaatatgtatgtataccaattagacctcagtaaacctgcttaaaattaattcacaggaagtttaatacttgacctggggacttctgatgccatctgtatcatatagagttcaatcagagaaagaaaaccactacatacacacgtacacacgcacaaacagatttaaccttacacaattgtggaagttggttaagtagtctcggtaaggttgtctttgccgcctgtgacgctggagcttaaagtccacagggcaggcagttagggaagggaagatggctatgaaatgagggaaagcaacaataagctggaacccacaagcacaagctgaagacaaggatgggctgaaacctgtgacagttcttgttgattctgaccttagcattgaaagaaatggcaaaaaactgcaattacctttgcacggacctaatagtatgattgttctgtggaagctggggagccttcatcacagagctaaacccacataccttacacaggagtagaagcattggaaagaggagtcaggggagagtggagcagttaaagcccagctgctgactctctccaacgaggacagttagcagatcagtgacaatgtgtgagttacaaaatggctgttgttctcttctgctatccaaatcttacataagaatttatcttctggcccactttaaccagaaacatataggaaggggatatcttaaaaatgtagttgagccttgccaagttgacacattccaaagccgtcataatagtcaatatattgtagggagagaagtgttaacatatttctgagaaccaggttttcaaaatgtggaactgaaggtatttactcagcagggtaaagaagagggcaagggtggtgcaaaaagaggtaacaaagcatatacttatttagtcactctctctctcctttcatttattaaaattgtgtattatttattctgtgtcggtcctgtactaaattgtatttgccaaaaatggccacaatatattccttccagcacaatcaccttacattgtgatgttaacactcctgtatcaagagatgtggtctacgtttactccccttaaatgtggacaggactgagactatggcagaagtgacactgcatgacttccgaggctagctcataaatatgattaatttccactgggctctctatctttctggagactctcatcatttaccccatgttacgaggaagcctaacctatatggagaggtcacatggagatgtcccagttgacatttccaaccatgatctcagcataaatcagccagcatcgatcactaaacatgtaagtgagtgagttttcagatgatttctgcccccagtctttaggcatcccttcccctccaaaataaagaaaacaaacaatgccatatggagcagagagatgagccattccactgagtcttgctcaaattacgaatttctgagcaaaattaatgttgtcattatttcaagctaccaagttttggggtaatttgttacacagccatagtaactgaaacaggctctttgccagaccaataaagtatataatggacaatatatattatgttattaaattgtacataattacctaaatccttttgctttaatattggttaaattggcttgaagttaagattttaatcaatacttttgtgtagtgggtttttttaacttttttttattattatactttaagttttagggtacatgtgcacaatatgcagattagttacatatgtatacatgtgacatggtggtgtgctgcacccactaactcatcatctagcattaggtatatctcccagtgctatccctcccccctccccccatcccacaacagtccccagagtgtgatgttccccttcctgtgcccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacaatcctttgggtatatacccagtaatgggatggctgggtcaaatggtatttctagttctagatcccttaggaatcgccacactgacttccacaatggttgaactagtttacagtcccaccaacagtgtaaaagtgttcctatttctctacatcctctccggcacctgttgtttcctgacttttaaatgattgccattctaactggtgtgagatgatacctcattgtgattttgatttgcatttctctgatggccagtgatggtgagcattttttcatgtgttttttggctgcataaatgtcttcttttgagaagtgtctgcacatctccttcgcccactttttgatggggttaaatggaacagaacagagccctcagaaataacaccgcatatctacaactatctgatctttgacaaacctgagaaaaacaagcaatggggaaaggattccctatttaataaacggtgctgggaaaactggatagccatatggagaaagctgaaactggatcccttccttacaccttatacaaaaatcaattcaagatggattaaagacttaaacgttagacctaaaaccataaaaactctagaagaaaacctaggcattaccattcaggggacaggcacgggcaaggacttcatgtctgaaacaccaaaagcaatggcaacaaaagccaaaattgatgaatgggatctaattaaactaaagagcttctgcacagcaaaagaaactaccatcagagtgaacaggcaacccacaaaataagagaaaattttcgcaacctactcatctgacaaagggctaatatccagaatctacaatgaactcaaacaatttttttaactttttatcttgagataaatgtagatttgcatgcaggtttaagaagtaatacagagaggaagatcccgtttactgtttacctagtttcccttaatagtaacatctttcctaactatagtacaatatcacagccaggaaattgatgttgatacagtctaccaaacttattcagatctcaccagttatacatgcagtcatgtgtgtgtatttagttctatgcagttttatcacatttgtagcgttatgtgatcaccactatagtcaagatagagaatagctgggtgtggtggcccatgcctatagtcccacataggaggctgaggcaggaggattgcttgagcccaaaagtttgagtccagcctgggcaacatagtgcgatcctgtctctacaataatattaataataatgaaatttaaaaaatacagaacagtcccattacaaggaactccttatgcaccctttatagccacagccacctcccttctgccaccaccacccgccaatccctagcaaccattaatctggtttccacaactatgattttgtcatttcaagaatgttatataaaattcattcattatggactgaataaaatcatgtggtatgtaaacttttgagattacctttttttactcagcataattccctggagatccgtctaggttgttatgcatattgatagcatgttcctttttacagctgagtagtatttcatggtatggatataccacagttaagtgttcactccttaaagagcatttgggtcatttccagtttttgaatattataacatccacgtactttttttgtgtgtgaacatacattttcatttctctgcgataaatgctcaagagtgaaattgctgtgttgtatgataaacatgtgtttagtttgtaagaaactgtcatgttctttttcagagtagccataccattttccattccctttagcaatgtatgagtggtccagtgtctctacattatcatttcaatacgtgtgtagtgatatagcaacttttttttgtaatatgatctgactagatatgtgtaaactctgttccttcttgttttcaccagggatcttattttcttcagagcttctaggcctagggcctgctgagaaatttcacacctatgtcaaatggtgaggggatcttttgttttcttaacaccacctcgttccccttgaccatccttcatgagatggagaagaaaatgagttatgtgggctccatagctaatggctggctttccttttttaaagaaactactcctaatagatatgcagaggctttgttccaaaaaaaatttaaatacattttctgcaagatattttaagtaaaaaaaattcaagataaagaatgataaggttagggacaagagtaaatataaggtttaatatataaaatgcatgaggtctcttgcaattgagtcacaaattttcctgtacattcgtagagttaagagagaaatgtggtgaattatctatttcacaacactcatagggaaataataaaccagtttctcacagaaacccagcctggttctgtgaccagagtggaaattcccccatgtctacggaggccacgtaggtaatgtaagtcagtgaaacagattgggaataagacaatagggagtaggggctggggctgagtcaaactggaaagcacatgcacagtctaagggcagctactactactcagcctcagccaatattccagagggaagcataagccctgtgttgccagatttattttgacttttaatatattagcaactatatcagtgaaaataataactgaacaaaatgcttctgtagtccagagctggtcaatcgctgccagtttaaaacctctggccttgaagagtaggcagaaacatctaatgcaagacaatccttataaatatgacctctttcagcctagctttgggtaactattgaatgtcactgagtcggtgattaagctttctgacatgcacttagaatgaagattgtatggatggtcaggtatggtgtcatacactttcatagtcagccaacaatagtaaaaatatgaacaaaagacttgaacaggtgcttcacgaaagaagatatccaaattgccaataaatatattaaaagcgctcaatgttattagtcatgaggaaaatacaaattaaaaccacagtgagataaaactacatactcactaaaatgataaatataaaaaacacccactcaagtgtgggtgaagatgtggagtaattggaatgctcgtacattgctgataggaatgtaaacttgtacatccttgtcatttctaatgaaatttaagacattccttcctcatcgcctagcaatttctttttttcaggtcatatccaaatgtttatttaactcataacctccataacacattaagttgaacttacagaaacgaaagtaaagcattggaaaattgatctgtggatacaggatatttctataggaaacaaatgtaaaacatgagactcaatgagtttgatggtgataataattaatgcttaggattcaacttatattctaattaatctaattgggttaactacaatcatgaaatattccatattttcctcttatgactttgtttttgtttgtttttttaaacttttattttaggtttaggggtacatgtgcaggtttgttatataggtaaactcatgtcatgggaggttgttgtacagattttgtcacccaggtactaagcctagtatccaacagttaggttttttgtttttttgtttgtttttctcctctccctcctcccatccgccacccttgggtaggccccagtgtctgttattctcctctatgtgtccatgtgttcctatcatttagctcccgcttgtaagtgagaacatgtggtacttggttttctgttcctgcattaggttttttttttttaatttttagtttttttatttcaataggcttttgggggaacaggtggtgtttggttacatgaataagttctttaatggtgatttctgagattttggtacacccatcacctgatcagtgtacactgtgcccaatgtgtagtattttatccctcgccacccccaccctttcctcccaagtcctcaaagtccaatgtatcattcttatgcctttgtgccctcatagcttagctcccacatatgagtgagaacatacaatgcttggttttccattcttgagttacttcacttagaataatagtgtctaattccatccaggttgctgtgaatgccattatttcattcctttttatggctgagtagtattccatggtatatacaccacattttctttatccactcattgattgatgggcatttgggctggttccatatttttgcaattacaaattgtgctgctataaacatgcatgtgcaagtatctttttcgtataatgacttcttttcctctgggtagatacctagtagtggggttgcttgatcaaacagtagatctacttgtagtttcttaaggaatctccacgctgctttccatgtaggttatactagtttacattcccaccaacagtgtaaaagtgttcccttttcaccacatccatgccaacatctatttttttttattttttgattatggccattcttgcaggagtgaggtggcatcgcattgtgattttgatttacatttccctgataattagtgatgttgagcatttctttcatatgcttgttggccatttgtatagagaaaatcttcacagtctatacatctgacaaaggactaatatccaaaatctacaaagaactcaaataaatcagcaagcaaaaaacaatcccaaaacttctaagtatatactaaccaaaagaaatgcatgtatatatccatagaaagacttggacaagaatgttcagagcagttttattcagactagccgttaactgaaaacatcccaaatgtccatcaacaagaaaatgagtaaacaaaaaactttggggtatattcatacagtgaatgagcaatagaaagaactaattgggatgcatccaacagcatggattaatctcaaaaacattaggttgggtgaaagaagccctacacaaaagagtatacactgtatgattccgtttatataaggttcaaaaacaggctgggcatggtggcttgtaactataattccagaactttgggaggccaaggctggaggatcatttgagcaaaggagttcaagaccagcatgggtaacatggtgagaccctgtctctacaaaataaataaataaataaataaataaataaataaataaaattagccagtcatggtggcttgcacctgtagtcctagctactagggaagctgaggcaggaggatcacttgagcccaggaggtccaggctgcagtgagtcatgtttgtgccactgcactcctacctgggtgacagaatgggaacctgtcttacaaaaaaaggatttaaagttcaaaaacaagcacaacttgttgtaattttaaaactggttgcctctgtgggtgggggaactgactttaattctgagagatgggaatgttctatatcttgagttgggtggttacatgttgtatatttttgctaaaattttccaaactgtactcataaaatttgcacattttactatatgtaaattatacctcattaatctactaaaataatagttgggtcctggaaaaaaaaaagcaactggacaaggacactgctagcctggcccaaccaaactatccagcttcacacagggaagaaatgtcagcctccatgttggcatgttgtacttgagtgcatgtgttgggctagttcccacacagaaatggcaaaacatgcttatagagtgcccgagagagaaaatccttctttccccagaagtttcctaccatacagagaggcagtacatgctaatggctaagaaaatgactttggagtcaaataacatagattcaaattttgtctttcccaaatattagcttgatgactttgaggaaattgttactgttccaagcctctcattgctcatctataaaatgagtatgataataccttcttcaaagtatcatcatggagattgtctgcaaagtgctcacttagcacagtaacacccatatggtattcaataaattgtagcatttcattctatattcatatagggaccaaatgtctgaacatctacctttcaaagcttatctaacatcttctccttaaagaactttccactattctaagactcctaggaagagtaacatactgagttcttaaggccttagtgcacattacttttagaaaaatatgacttccctcagagagaagcaaggtgggtaggtcatagggtaatttacttgacatagatgtaagggaaagcactgctaaaggaagaggtgtcatttaggattcctgtttgcaagtaattgaaatgatctttggcttaacagaaggcagaggctggaaaatcaggcctaggcttacagaaaccaaggtcactctgtaggcctaggccacacaattcataccaactaacttaaagtaggaagtaaccaataaacgcatgacctacatttgtttcattgcatcaattcctcaagatccaaagtttggggaaagagtatcagagttgtctactttgcagccccaacagtgtgaaagtgttcctatttctccacatcctctccagcacctgttgtttcctgactttttaatgatcgccattctaactggtgtgagatgatatctcattgtggttttgatttgcatttctctgatggccagtgatgatgagcattttttcatgtgtctgttggctgcataaatgtattcttttgagaagtgcctgttcttatccttcgcccactttttgatggggttgtttgattttttcttgtaaatttgtttaagttctttgtagattcaggatattagccctttgtgagacgggtagattgcaaaaattttctcccattctgtaggttgcctgttcactctgatggtagtttcttttgccgtgcagaagctcttcagtttaattagatcccatttgtctattttggcttttgttgccgttgctttttgtgttttagtcatgaagtccttgctgtaaactagttcaaccattgtgaaagacagtgtggcgattcctcaaggatctagaactagaaataccatttgacccagccatcccattactgggtatttacccaaaggattataaatcatgctgctataaagacacatgcacacgtatgtttattgtggcactattcacaatagcaaacacttggaaccaacccaaatgtccatcaatgatagactggattaagaaatgtggcacatatacaccatggaatactatgcagccataaaaaaggatgagttcatgtcctttgtagggacatggatgaagctggaaactatcattctgagcaaactatcgctaggacagaaaaccaaacactacatgttctcactcataggtgggaattgaagaatgagaacacctggacacaggatggggaacgtcacacaccagggcctgttgtggggtggggggaggggggagggatagcattaggagatatacctaatgtaaatgatgagttaatgggtgcagcacaccaacatggcacaggtatacatatgtaacaaacctgcacattgtgcacatgtaccctagaacttaaagtacaataataaaaaaaaagagtttttattattaaaattgtatgctctcacagggcagaaactatagctattcttcatttaaaaaaaaaaagagtatcagatttgtggagctcagaccaacttctctttcctggctctcaaactaggcaaggctaggaaagactggatgtcttcggcttccaaagggtggggcaggaacctggaattaccttacaccaagactaccctaatcagggagagatattcgccaaaagaaaattggggtgccctgggaagtggcagtggatactgggcagctggaaagtaacaaatatctacaggaacacagggcacagtagtggagggccagaaaataccatttcccccttcttagtgggttcttaagagaccttgtatttggagctcaacagctttttggtgatcctattattaaattaatctcaacaacagctctgagcagtagagagggactatcaatttatttccttattagtgacctgttctgtctcattgtatttatttcttaacagttcaattgctttctgtggaggttagcaggaagcccagagcaaatatttaagagcatcatttgttatatgttacatatattatatattatatatactatatttttacacatataaaagttaaaagattagggtgacttcttgcacaaatcttagtaaaacaactgtactagctagtaagttatatgcagtagtcattaaaatgttgaaatatagggaaatgtaaattttagctcatttaaatatttccagaaaaaatattttattttcatagaaatgttactttggtgttgcctactacaacctttttgggaagaaggaggccaaaatataaatttgaaaattgtacttaaaatttattttaatttttaaatttccctcagactttcttatatacatttttcctcagcttgagagaaatcatgtgctgccatactacattttttaattcaatatgaactttattagaaaatatttttacttcagttaatctttctgtgtgtgtcagtgtgtgtgtgtgtgtgtgtgtgtgcacatgcacgcgcttataaagccttggtaaattttgacaactgccttttctgagtggtataatatcatagctcttttgcaatcattttgaattacgtgtacatgtcaaccaattcaagtacacttctgctctataggcaacttcatttagtttaaaaaaaaaccttgtttttaccataacactgtgcttcacaaaaaatgataataactttcatattatatcacaaaacaaataactgaatcctcaatgttgaacttttaaaatgaattttcaatagaattcaaaacaatatcatattttccctttgacagaatgaacttctaaaacttttactttgatacaacgaattgggtgataaaaatttagccatcattggaattaacggattgttttatttgaagcattcaatatcactgatataaaactgacctcacttaattctttgcaaaactctgctaatgaagtgaacacaataacatctatcagttcatttttaatatatgcacatgaacacttggaatagaaatgaatggcattaatttaggaaaatgatgatttgatccaaattaaaagtcatgctttactgagtgatatgtaaatacaccttctgaagtcgtattaatacgtgttaaatggccatcttcgggcccaggcttcttaaattaactatgaagttttgaaactacgaagttttctaagtgcagcaaaccaccatggcacatgtatacctatgtaacaaacctgcaccttctgcacatgtatcccggaacttaaagtaaaataaattaaaaaaggaaactacgaaattttgaaataaatgtttatgtatctttcacagatctacctcctcagattttatatagccagtcaatattattttggctcccagggtggctggtaaatggctcctaaacttttatgcaaattacatgtccatgatcaactttcttgagaaacggaaagtcagtagttcggttgttattaataatcatgtgcttcatttttttttcagaatgaagcatcttgtttacggcttaatatatatgcatataaaacacacttctgtccactcccccataagcgggtccaggcagctccttcctacagagggtagggaagagggccatcagggcagtgcctattttctcaaaggcacttaccctcccctcccgaaatgctccatgcctccagttccaataccgggggccaggcaggaagcccctctgaaaaagaaagggcccccccaaaactcccaccccaccttggtttgagctgcagttgtggaggaccttgctgaactctttggcacccctcatttctgctccctgttacatcatccaagccagaagcacaagtcacaggtaggtggggtggggggaactggtctggtgttggctcagtcaggtggttgctctccctggaggactccccagggctgatgtctctgaggctgtagaatcctgatttggactcctccagccccatattcccaccatattttgtgaggtgagctcctgggctctcactggctgcctgagggtggggctgatctcagttggagtcagaatctgaggagtcccttgaagaggaagagctggtggattcattatcttcatcctcactgccatcctcctcatcatctttatccttgtcatcctccttattcttgtccctatctttgatctcatcctcaatgctggacttggaggagtccccaccatcagaggagtcactagtctcatcatcttcctcttcttcctcttcatccttgctgtccttctcctcagacttctaattggacttcagggtagtccagctggacttggagttcaggtctcaaagcttagtcatgctcttatgttcattggagatgtactctttgtaaattacatggtcctggggagacagactcttgatgcagaggcccaggtgtaccttgcacacttctgctgcttcttggccagctttttgtagtgctccttctggctctgggagatgtgctgccagcggctgccattctccaccatgcgctccttcagtggcaggtggttcagctccccattggacagcagctcctgggaactgttcatgggaggcttcttggtttctcccaggaattttatcttcctggaagagtttctagcaaccagaggtgcctgcatctcactcggctctctcttgtatcacttttggtgtttagctgccttcttaatccatagcagtttctccttcttctttatgttattccaggtcatctccatggcttttgaggccttcacccagttgttcttcaattgggccatgtagtcactaatgatgctctgttaccagatcttctctgctgtcttgggtgactctggcagcttgccctgtgcctggtgctcccccctgggccttgttcttggccttcttcttcccagatcattccacatttgggccagcaggtaggtccactcactcccagggagctcaggctgctcctcccacagctgctaccacttctcctcaaaaaaaaaaaaaaaaaaagaaaaaaaagaaatgaacacatccaatatgggccacttaggcttctctgagctgtcctcacccccatcttggggtggcttcttggaggccaggctggtggcttgcttcttgttgctattcaacatcttctccttccccaggacccactactgctcctccctggggaagtctctcaagtaaatggaggagctccacctcataatgtttctttttctgaatgcacttcatgtgataggcatccttctccttgtgggagaggagcttccactgttggttgcacagcaccatgtactctctgctgggtgtgtccttcatgtcagccatgagctcttctcagtacggcaagtagctgttgggaagtggcttggtgggtcatccatcaaacttgtccttgagctgccattctcagccttggtgaaggtgaacttggtgatgccgaccccactgatattcggctcaaggtgcttctggatatagtcccacatggtctcctcatatttcttctgctgatccagggccttactaatccatttcagcctcttgttgtcccagagctgagaccactgcttcttaggaagtccttcaccttcttacctgcttcgtagtggcatctgggctcactttgaaatacaccttcttctcatgagtgtaccacagttgctggggaatttggggcttcttggggatatctgacttcttgtcattctggattgggtcagagtgatcctctttgaattgggtcaggtttctacagacttttgtttctccttatggaagccctgcatatattttatcttcttctccggaagctgcttggatttcttggatataatcttggtcaggtccagattgctcatctcaaggggagtttcacatacttgttgtgcttctccatgaagaagggaaataaggaagcagggaattccttgggaaatctgcagggtttttttgtttgtttgtttgtttgtttgtttgtttgtttgtttgcctttgtaaggatttgtaacatgtttctgagcattgaggatcaattctgtcaatgtatggaacttcctggccttgttagaaatctctacccattcaagcttacacatgtctacagaaaagtccttaaatgctacattttcccactccgtatgtgacttggtagttttgaacttggagctgtcattgactgtaaagtaatttttcaagcattgtggcaaagtcatcatgtcttcctggtaccagcagtcttggcctttggggatggccattttcaggtctgtggggcagtcagtttttctctttatcctccaggtgtccagctacctcttccatggtgctggctggcaacccaggatcaaagccacctcaccctttagaagacataccaattcccactcaggcaggctgagaggtgagggactttctatccctctcccctctcaaagaggaggtgggcacaggtcccacactctcagagataaccagccaagaccctaatagacttaatgggttggtagatgtgggagcatgctcctccccttcttcctaacctctcccctatcccctgcagcctggctccgtggtgtgcacactcccctgcccactggaaactgctttctgcttccatgtgcagtgagcacccaccctctaccttccttccccaaccctggccaacaaaaacctcctcctccttggagcacccaccgaagggaggctccaggctacagggcctgcacttcacttttaaaaactcattgtaactaaaagggtttgttgaaaagtaaatgccccttgtaagttggattcctaagtattttattctctttgaagcaattgtgaatggaagttcactcatgatttggctctctgtttgtctgttatcggtatataagaatgcttgagatttttgcacattgattttgtatcctgagactttgctgaagttgcttatcagcttaaggagattttgggctgagacaatggggttttctagatatacaatcatgtcgtctgcaaacagggacaatttgatttccttttttcctaattgaataccctttatttccttctcctgcctaattgccctggccagaacttccaacactacgttgaataggagtggtgagagagggcatccctgtcctgtgccagttttcaaagggaatgcttccagtttttgcccattcagtatgatattggctgtgggtttgtcatagatagctcttattattttgagatacatcccatcaatacctaatttattgagagtttttagcacgaagtgttgtggaattttgtcaaaggccttttctgcatctattgagataatcatgtggtttttgtctttggttctgtttatatgctggattacatttattgatttgtgtacattgaaccagccttgcatcctagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttgttaagctattgattattgccacaatttcagatcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggattggtggtgatatgccctttatcattttttattgcatctatttgattcttctctctttttttctttattagtcttgctagtggtctgtcaattttgttgatcctttcaaaaaaccagctcctggattcattaattttctgaagggttttttttgtctctatttccttcagttctgctctgattttagttatttcttgccttctgctagctgctgaatgtgtttgctcttgcttttctaggacgtgaaggacgtcttcaaggagaactacaaaccactgctcaatgaaataaaagaggatacaaacaaatggaagaacattccatgctcatgggtaggaagaatcaatatcgtgaaaatggccatactgctcaaggtaatttatagatgcaatgccatccccatcaagctaccaatgactttcttcacagaattggaaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactagtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaactctagaagaaaacctaggcattaccattcaggacataggaatggacaaagacttcatgtctaaaacaccaaaagcaatggcaacaaaagccaaaactgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgccggagaggatgtggagaaataggaacacttttacactgttggtgggactggaaactagttcaaccattgtggaagtcagtgtggcgattcctcagggatctagaactagaaataccatttgacccagccatcccattactgggtatatacccaaaggactataaatcatgctgctataaaggcacatgcacacttatgtttactgtggcactattcacaatagcaaagacttggaaccaacccaaatgtccaacaatgatagactggattaagaaaatgtggcacatatacaccatggaatactatgcagccataaaaaatgatgagttcatgtcatttgtagggacatggatgaaattggaaatcatcattctcagtaaactgtcgcaaggacaaaaaaccaaacactgcatgttctcactcataggtgggaattgaacaatgagaacacatggacacaggaaggggaacatcacactctggggactgttgtggggtggggagaggggggagggatagcattaggcgatatacctaatgctaaatgacgagttaatgggtgcagcacacaagcatgtcacatgtatacatatgtaactaacctgcacattgtgcacatgtaccctaaaacttaaagtataataataatttttaaaaaataaatgcatcatcaaacaataaaattattgtagattagcatcatacaataaagaaaaaaatactgtagtaagagcattcaggctaatctctatatcaagggtcaggccagatctaacctataacctgtttctgtaaataaagttttattggaacacaggtgctctcatttatgagtattgtctatggttgcaacagagatcttatgactcacaatgcctaaaatatttaccatctggcactttaaaaaaatgtatgctgacccctactctatatgtaacatggcagggatggtcagcctctatttccaatacatattttacatacacctaatccagggtttcccaaccttggcactattgatgttttgggttgcataattcttcgttgtggggggtactgtcctgtgcatcatgggatgtttaacagcatttgtgatctccagtcactaggtgtcagttagcaccctcccacttttgacagtcagaaatgtctgtagacattgccaaatatcctctagtgggcaaaattactcacagttgaaaatcactgacctaacttgtaattttgtactgatctcacaaattgggacatggcagtgtcatgcaacttgaggctgtaacttaatacatagcacaactggctgctacttcaagtggccagtggaagcaaagcaatgtggaatacttttcccactaccttccaaggccatgaaacattagctatctctagtcacaaatcgagtgccctgcattctgtctttagaaagaatgtatgagtttctttgtgtttgaaaaaggtcaggaaatgagtaacgggttattgttaatcattttttagatttaactatgtgttagggcgagaacttggttcactacctatgtatattacacactgctacaaaagattatgacagaatcttcaagtataaagtggaggtctactaaatctatcaaacaatgtgagctgaatgagtaaataagtaatgcataataaatccactacaaaatttctaagtctttggattccttcacctatatcatactgagaaacttttaacatctcaacttcctttactctggcccccttattgagttcaactaaacaaacaactggaactactcccagcatcttaacctaacacaatggaatcagaatctcctggtaagtgcttcttaaacaatgaactcagccttatctagtattttgtccttccttcattggtatagcacccactgaacctattatgattcttgccaatatacattagtaaatttgcaatttggcaactggagactgccatgacctgattttagtttaggtgttgcaataattagaggtagtgggctaaatagaattttctccccttttcaaggtaacactctcagcaaggttgttacagggtcttcaaagaatggcggaacagcctcataaaccaggagagaaaggaagattctatggtttggggtactgagttatatgagtcttgccatatgtccccatttcagttcttgggatctcactctctcctaatccaaatataacttttatgtaaaatatctggtaaatcaaagtttttatgcagcagcccaagaatcaaaatttgagttttgttttcaactatctcgctccagtggctgcaagtgataagagattctttgagaaaaatcatagaagttccacaattttttggatttgtcttgatataagacattaaggctttgaggttgcttttcttttctttaagctgccaagttcagctagaagcagcgctatactatgcctttcatattattctattccaactaccactagatccttcagagtcttgcccaaaatgagcacattattactaatgagcatagataataattagctatttctttgatttgagcatgtcttggactactggttgagtctttagagatatcaacaacaattagaagaggtaataaatctgagatttccccttattttcctgaggatctgttgcttgccacctcttttggtaccaatttctcaatcaggttggttattaagtagaaaagtcattcattaatagttctcacaattgctcagagccctggtaaattgagcttgaagccaaacttccaggaatagatctgaaaccatgcctcaaaacagacttgataaactactgccactgattgctagaggaagcctgcattgccactatccttacgccacatctatggcaggaactcaactttgcaatcaccagaaagctgctgtcattgtaccagtagatgctaggcacatctccaggagaaatggaagcaccaaagattgttgccttataaaccacaatctcacatggatgcatttgattgctgggtctaggtcacatctatgtacagtagttgcaagtggggctgtgaatttgagtttatactcttatgttggagtccaaaggccagggagcctggagttgttttccaaggacaggagaggaatagtgtgtcccagctttagcagatccacacattcatcttttctctgctttgttctttctggacccccaatagattggatggtacctgcccacatagagggtagatcttctccaccaagtctattttgactcacagctaaactcttctgaaaacaccctcacggacacactccaaaataatgctttaccaggtttctaagtattctttaatctcatcaagttgacacctaaaattaaccataacacacacaccatcccaaaatttaatgttttaaagcaacatttattttgttcacaaatgtgaaatttgggcaagaaacaatctgtttcattcagtgtaagcttggggatagaatcacatgaaatctcagtcactcacatgtctagcgactgatgatggctttcaggttgagactttaactgaggccattggccagacacctacatgtggcctgtccacgaagaaccaaactgtctacccccacacagcttactgtctacattaacctgactttactattccattgtctttgttagtataactttggtattccagtagactattgcccagaaagacaaaagttgcaagtaaaattattgttctttacaggagtttctgaaagttgtatcattcttcagtagaagagtttacatcgtaagattatttgagcctctagcctcaaaacgcttaccttgtagtatccaccaatcctaagatccttatcctattctaatcaagctcctgtgttgaaagactctcataaaccaaactcccagctctcaatatagcatcagactttgttctcctgttctgagactctctcagattccatgaagtatcactttaagcaatatattcaacttagtcttttcaatgtgttgttctggtgatatttgggaagccagcatttgacaccatgtggcctgggcttctttacaacatggtggctaagtttcaagagtgagtattccaaaagaaagctatgtagaagtgatatagtctttttaaagataagatcagaaatcacacagcatcatttccactacattccagccatggaggtaaccacaaatgttcacccaggttcaaggaaaaggggattagacaacaccatttgatgggaggaatcaagaattttcagacagatctctaaaccatcacatcccctaaactcaattaacattgtctacaggttcttggaaactgcaattttaggtacaatgcctaaggaagccaacttttccataggctaattgatataaacaagagtgatgagattgatataaacacgagtgatataaacaagagttcctatggcatacttctggtcacaaaaacatcaccaaacttctaaataaaaaccaaaacacatctaatattaaatatattgtcgtggggtggggggatggggagggatagcattaggagaaatacctaatgtaaatgacgagttaatgggtacagcaaaccaacacagcacatgtatacacatgtaacaaacctgcacgttgtgcacatgtaccctagaacttaaagtataaaaaaagtataattatcaccaattatttgattttgttcgtagaaccataccaaatttgaagaaaaatgaaatcaatgagaagctttgtttctaaggtttaaagttaaaagggcaattgcagttgtccaataactaaagataatttaattacttgttgaaaattattttgccttgattatctaggaattggtaatcaaaacataagagcatatttttgaaactgataaactgagttgttttctttttttcttttttttttttttttttgagatggagtttcacttttgttgcccaggctggagtgcaatggcacgatctcggctcaccgcaacctccgcctcccgggttcaagcgattctcctgcctcagccttccaagtagctgggattacaggcatgtgccactatgcccggctaattttgtaattttagtagagacagggtttctctatgttgaccaggctggtgtcgaactcccatcctcaggtgatccacccgcctcggcctcccaaattgctggtattacaggcaggagccaccatgcccggccatgaggttttttaacataagcatttcttatttcaaaaggaaggtagtagttctaaattttaattctacacctcaaatgtaattcattttaacattttatctgcatctgactgatttcatcaatgtaaaataaagcaggtggcccaattcaggcaaacatgtactgagcatctgttgaatgaggccttgtgctaggtgtggcaaagaatatagagacaagaataaatgctcatttgtggtttactaaacaagagaaccaataacttcagtggtgagatgtccgggaaaattttataagagttgctactgataagctcaattccactttctgctagggaagagagaaattgcataagaggataaaataataaaactcggttttggctgagttcccaaaggtggaggaaaaccagtaaattccaaatacattcacatgccagagtgaggcatcggacttgcaaagaggatggagcaaaagcaatagttttcaatccttaagatatcatctatcttgaagttacatcattggcttcaagatggccactcagcttcacatatgcctctgaagcttgggagactgatgtctaacactctcagagataaatccaaaagaaagtgaatatggctgatgctgaccctgcctgataacacattgagagagtactgcattagaagtgagatgcactttcgctttcaagcaacagtggggcaagggtgcttgaattttcccatgggccaatggaagggtggaattggaattctgcccacgaggattcaatcctattctgcttttctattccagagcctttccacacttactcccacaggctgagcaaagcgcctgcattgtttcaagtttttccctccatgtagacaatggatggatgctttatttctccagtgctcatgggcctaatgattcatgactgtgttagccccttttaccattttcagggcttgcaggaaaaataatcctaggagattcatacttagagcagaatgcggcccaaacacctggcaatcatgttcatcattctcattttttacctagatcatccttgatgccagagcaaggtttactcaatctgatggacatgccttttatttctcttggcatcacccacctctagatagtcataaaggatagcggatggcttattatgtcaagtatttctctcataactaaataaattatatagataatgcagtgtctgtaagtacttgaggagacttggaaaccttttacggtcatcaaaatgaatatttttctattcatcagcattcacaactattgaatctttatctgtttgtatggtttatactggggctttccacccctgcccccccgccattattatttctccacttggccattcctattcagagcctttcaccttttatctctgacatagcttggttcaagagcttaattttttttaaggtaccatgaccaagtcaatttatatcctgaagaagggattacatgattattcaaatttggcattgctacacatagaagatatctgtgtgatttacttacatttacatattgactttcatgatatctagcttaaatcttgacagatgaaggaacacaacagcagactttgggaaacattttttcaattaatagtacatttcgttatactgagggaaggattgaacatatacatttattattttagctcagttttgagatggtgtacattttttgcttgttttatgtttatactgccagtgtttgaaaataaatattcataattcctccttttttacacaaaagttacataggcactatattgtaacttggcatttttagttaatgatatattttagagtttgtagtatatcaggacataaaaagcatcatcaatctttttatagttgcatagcattttactgtgtggatgtatcataatttctttctttctttttttctttttttttgagacaaagtctcaaaagcctgtcgcccaggctggagtgcagtggcgcaatctcggctcactgcaacgtccgcctcctgggttcaagtgattctcctgcctcagcctcccaagtagctgggactacaggtatgtgccaccaagtctggctaatttttgtattttttttttttttttttagtagagacgaggtttcgccatattggccaggctggtctcgaactcctgacctcgtgatccacctgcctcagcctcccaaagtgctggggttataggcatgagccaccgcgcctggccatgtatggtaatttcttagacaaatccccaattgttggacactgggtagcttccaaactttcactattaccaagaaaacctagctacaacaaacaaccttgcctatacgttttcttatatatgtgtgtgcatacatgtatgcacatatacctatccagaggtagaattcctgagtccaaactgcatgagtaattttgatgaatattgccaaattgcctttaacaggagatgtactattttccactggaaatatatatgggtgcttgtttctttacagagagggccgtagtttttaatgaactcagtttttttttttaactaaaaacaaaaccaaaacaaaaaaaacaaacaaaaaaactcccattttagagtcccttagccagaatcaggctttactttctctgtgtggagccaagttcattatttcaattcacagacagggtaactcatgggcaaataggtttttttctaaacataggtcttaagttattacattttgaaacattttttttgatttctgctaaatttctatttacatgatacattttattttaactagtacttcttaaaaatttgatatatttgaaccatcaggacagagtggtggtagcttcacatggaaagataggcttatgtttatacataccataaaatttttccacttctttactcaaaaaataagggtcccttgagggctaaggattatcacagttgacctcactgtcagaaatattaccagtttgtgagatacaaagaacaaattacccttatacatttataatttatcattttgttttattacataactaaaaactactgaaaatataaaataactcatttaggaacaagtttttagataattcatccataaagaaaattcatttggtttttcaaagaaaaagaggaaaacaagattggtgataccattaacatattttgcttttaaataacgacatgatgttggtcaaaaatttataatgttttaatatataaccccatatgaccaccagaatttggggtcttccttaggtgtagtgtcataacaataactacaataactcacatttttgtggtacttatggtttacaaagtacttccatgtacctgataataatttcagctgtcattagttgtatatgatacacactagaagatattaatctcttttcaccaaaaatgagagaaataaaaatgcattatttacttaaagtcgaaaagccagtaagtggtaaatcatagagacagaatggtggttgtcagtggacgtggggagaggggaatggggagttattgtttcatgggtacagaggttcagtttttgttttgttttgttttgtttttgagatggaatctcactctgtccctagacgggagcgcagtggcacgatctcagctcactgcaacctttgcctcccaggttcaagtgattctgctgcctcagcctcctgagtagctgggattacaggcatgcgccaccatgccagactacttttttttttttttgtatttttagtagagaaggggtttcatcatgttggtcaggttggtcttgaactcctgacctcatgatctgcccccctcggcctcccaaagtgctgggattacaggcgtgagccaccacacttggccagagtttgttttacaagataagagttctggagatggatgttggtgatagttgcacaacaatataaatgtacttaacaccactgaactgtacagttaaaatggttaggatagttttatgttacgtgtatttcaccacaagaaaaaaaaaagctagtgaatgatgagcttgtgtttgatatctgtccaaccttttctttctactcaaagcagttattatcccggtgttacagatgaagggactaaggcctagagggactgaactgacttacgtcatgtaactatcaagtggcagagttggagtttaatataatgtaagtgattttacatgcagaggcttagcataggaagtaaaaataaaaccaagggatcaattaaccactaaggactgggtaatcctgggttaatcacttcatctgtttgggcctcagtttactcagttgtaaaataaagggactgatataaatcggaggtttttttaaagtcaatgtttttgaccatgactaaaagtaagaaatgttttatattgaccagtacacagacacacacaccaccaccaccaccaccaccaccactgccagcataccttgtcctaggttgggtttcccagatgtagatcttgaaatagggatttgagtacaatttattaaggatatgctcccaggagaaactggtactggaatagaagaaatagaggaaagaggaggaaaagggtagaaatcaaccaagtgtgagatttcaggtgaagtcctggcctcagccttattccacagggagccgtagagcataaaatacttcatataatttgatcagccttgaggcaagagagtgaggctttcatacttcatcaccagtcaatcactggttacaggctaccccaataccatgtaacatcccaggcattgcagctcatggtacttgtggtagccagtcccccaaaggtggcccccagtgatcactagctcatggtattcacaccttcatatagttccctcctacactacaccattgttggtctgtgtgaccaataaaatacagcagaaatggtggtatgttgggatgagaaggagggggaaaaaagaaaaataaataaataaataaaaagaaatgatggtatgccacttctgagattaaaatgtaaaaagctgtgggatccatcttggattctctttttcttgggtcactggctctgggggaagcaaggtctcattttctgagtagtccaatgaagaggcccatgacacggactctcatgacaaggaactgaggcttctagccaacagccagcaaggaaccaaggcctgcaacaatgacttgagtttgaaggcagattttccaacctaaatcaagccttgagatgattgtagctccagctgacagcttgagtgaaatcttttgagagaccctgagccagaaccacccagttatgttgctctcagttttctgaccctcagaaaccatgtgagataataaatgtttggtgttttaagtcactaggtttttgaaaaaattgttgtgcagcaatagataaacaatatcatacactgggttgatgtggctccaatagctgaagggtagttctctgaagagcttgaggggatatcgtgtaggagagtagcacaaagacgctggggaataggcagaaccagtagaagagacctgagtgacataagcagagcatccatcatatctgctattcccccaaaagcaaacatttcatgaaacgacacttattatatgtgatatactctgatattttttattctttttattaaatgataaaagagagccctcaaattgatttcataatacactaacagatgtgacgtccagttgaaaacagtgaacataatcatctttaaggccccttatagatctaaactgctgtaattaggaggtggcacagttgttataatgataactaacatttaataagcattcactattccagaattgttctaaacacttcacatagactgtcttacgtgaagacaataaggtaggtactattactatcctcattttacagatgtggaaacttgtaaatgtcagaggccaggagggaatccaggcattctgactccaaaacctattgtcaagagtgtaggcttctatattagactgtttgggttcaaattctgattccaatggttgatcaataaatgttttcagttatgatgatgatgtacccaattattagaaattcactgatgtggataattctccctattgtcaagagtgcaggttcctgtatcagaccgtttgggtctaaatcctgatgccaatggttgatcaatgtcttttcagttatgacgatgacatactcagtgattagaaattcactaatggggataattctcacaaaaggaagtttagggccagggttatgtacatcaacattgactgaattcagcagttcaacgcattgataataagttcaatgttctgctccgcttcagccacactgacccagtcttcactttaaatgcagccactcatgcatttcaataagaaggggccctggcctaggttacataacgtctgcatgctttaacagctaaagtacacttcactgtaaccaaataggatagaaggaatttcaacatattcatttttatgtattgggttcattaaagtgcactcaaagataattctctaacaaacaaacctaactaaaaatacactagtcaccatcatgtagaaagtattcctactaaattcagtgaacattaattaacctttggatttcaaaaatgggatcaataaacacggtacaattgactaaaaggggtaaaaattatttgcagaacctggacacctggaactatcatctttttggttaaattcctctgagccaagtctctatcaattatatctttcctttcacaggaataaagtatttatcacaggtattagagtcagtgtaaaagcacaacatccttttaataaaacattctcagtaatcaaaaattcatatacctccagaatgaattatttagagctggacacatataggggaaatgtgtcaggaggatatttcagcagctgctgtgttgtaaggtgacatggaagctttagaaagagggcagaaagaaaaaaaggtttaagtcctactttagatgctattggatgattatggattataaggaacaagactggttgcaaccttgcttagaataccgctagcaggggtaagacagttttctcacgttacctattttttggaaaaaaaaatcatttctaatatgttgctaaaaagggatttacagaggatgtcatatttctcaaaccaaatatcaatctcgatgacctaaaaattaacaattcaaaataaaactttttctaattataaaagaagtcacgcttttacagaacatttaataaatgtagaaaatgtaaagaaaaaacacaaagtgatgagatattggctcacgaagtaataattatttatatgtatgtatagatacacatctccaaattgtgtgtgtgtgtgtgtgtgtgtgtgtgtgtgtgtgtgtatctccaacttggcatcacactgtaagttcattttgcaattttactttttactttttaaatttttattgaccatccccactccctcctcccaactacctttcccagcttctggtaaccatcattctactctctatctctgtgagttcaattgttttaacttttagctcccacaaataaacgcaaagtttttctttttgtgtctggcttatttcacttaacataatgacctccagttccatccatgttgtggcaaatgacagtatctcattcttttttatggctgaatagtactccattgtgtatatgtgccacattttcttcattcattcgtctgttgatggacacttaggttgtttccaaatcttggctattgtgaatagtgctgcaacaaacatgggagtgcagatatctccttagtatactgatttcctttcttttgggtatatacccagcagtgcaattgctggatcatatagtagctctatttttagtttcttaaggaacctccaaactgttctccacagtggctgtattaatttacattcccaccagtagtgtacaagggttccctttcctccatattcttgccagcatttgttattgccttcttttggataaaagccatttaaacttgggtgaaatgatacctcattgtagttttgatttgcatttctctgatgatcaatgatgttgactactttttcatatacctgtttgccatttgggtatcttcttttgagaaatatctattcaggtctttcacccatttttgatcagatcattatatttttttcctatagttgttagagctccttatatattctggctattaattccttggcagatgagtagtttagaaatattttctctcattctgtgcgatgtctcttcactttgttgattgtatcctttgttgtgcagaaacttttaaactcgatgtgatcccatttgtccatttttgctttggtggcctgtgcttgtgaggtattattcaagaaatctttgcccaatccagtgtcttagagagtttccccaatgtcttcttttagtagtttcacagttcgaggtcttagatgtgactctttaatccattttgatttgatttttttatatggtatgagagaggggtctagtttcattcttctgcatagggatatccagttttcccagcaccaattattgaagagactgtcctttccccagtgtatgttcttgggaactttgttgaaaattagttcactgtagatgtatggatttgcctctgggttctctatttggttgcattggtctatgtgtctgtttttatgccagtaccatgctgttttgtttactatagttctatagaatgatttgaagtcaggtaatgtgattcctccagttttattctttttgctcaagatagctttggctattctaagtcttttgtgattccatataaattttaggattgtttttctatctctgtgaagaatgtcattggtgctttcattgtaattttattttttttttactttaaaaatattgtgggaatttccttgtgtcaaattattctgcttcaatattaatttcatagctgtatagaattccattctatgaacatagtacttgtaattcagttatctagtcaggcaagcagaaactactctgtatatctaatgcagaaaaggactcaatgtcttccgtttagtttctcaattcatacaaaaccacatccaggccatcaccaatcattctatatgacaaatgctctttttaacaaccccacaatatcgccccttaccacaaaatcttccttcagcttaacctttcccactctaggttcccacaccacccctaatcccgcttgaagcagccctgagaaacattgcccattatctctccataccaccccaccaaaattttcactgcccgaacacttcaacactattttatgttttcttattaatgtaagaagacaggaatgtcaggcatctgagcccaaggtaagcgatcatatcccctgtggcctgcacgtatacatccagatggcctgaagtaactgaagaatcacaaaagaagtgaaaatggcctgctcctgccttaactgatgacattaccttgtgaaattccttctcctggctcagaagctcccccactgagcaccttgtgacccctgcccctgcctgcaagagaaaaaccccctttgactgtaattttccactacccacccaaatcctataaaatggccccacccctatctccttttgctgactcttttcggactcagcccacctgcacccaggtgaaataaacagccttgttgctcacaaaaaaaaaaaagtaatttgctataaggtacaaaaagtactgaaaaaacacaaaggacaaaggtgtgtatcagttagctattgctgtgtgacaaaccaccttaaacttactggttttattttaaaaacaattctgtggtcagcaatttaggctgggctcatctgggtagttctctggtctcagctgaactccttcctgctggttttgggttgactttgcagattgtggctgggctcccttacatatttgagttatcagtggagacaagagggctggctagactctgatgcacatggtttctcattctctagcaggttaatctgggattattcccatggcaatcatagggttccaaaagagtgaggagaagatggtgagtccccttgaggcctaagcttagcactatcacaacgtcattttcactgttttctattgttcaaagtaaggaataaagccagcctagattcggagagagaagaaataaattttactttttatgggaagagctgcaaagtcacattgaaaaaggtcatggaaagggagagaaagaattttggctagttttacaattcattacagtatgttttacctagagaccagaaagctctactactcctgagctgggacccacaacccatcacttaatgctgatctgtgagtgatgctaacactgctgcttttgggggtgctgctcccactgagtaggaatacaggatgccatagctttactaatgctgttaaaactgccacagatgttttggaaagaaatggctgctatagtcactgttgctgctgctattactgctggagggatttccagagacagaaaaaagaagcttatttttctcctcacctcatagtctctccaccagtgcttcccaatagcaaacctaacaggaggctaattaggaaaggaatctgaaaaatgtagtttgtgggtttctagctccctgtgatacagagagaacattgaaagtataactgggagccaagtgaaaaattgctgcacaacaatataatgttttaaactgatctcctgtgtggagacacaacataagcgtggaaagcaaagccatcagtgggacagtttctgaatccagtggacaatgatatttaatttctaggagaggtatttaagaagggatatgttctccttcagctcagtgagaaaaaggtaatacataaaacagagcacctctaagtaactttgttctagacatccaagagcagatttgtgttcattataaagggaagaacactggagttctgtgcatgaggagcaacaattatatagttgacctcaaaaattgttttcttcacattatattcccatttggttgagatctgcagattattcttaagttataatttttgtaccttgaaatacacaaaaattttacttgcattgctctatataacagtagtcacagaataactataaggtcctgaaaatactttttcaaaatgtgtttttagggtgtagcctctatacacaacattttagaaatgttttaatttttattataaaaataattcttgtataaaatcaagtgagcgcctgcagaggtagaatttcttcttaataccatacagagatggtcatgtatgtttatcctgattttttcccataaacactctaatgtattttgtgattataatcactgaagtaggatattataattctcttctctaacttagaagttaaaaattatgtataatgtgttttgccttgtagatcttgagttttaatacagttaaatgtatctactattttaaaattgcgtcattgaattctatagcatggatatactgaaatttattttatcgtttgtcttcccatgtagagtacaaactcccttaggacaagggccttgtttttttggctcacagctatatccccagtgctaagaaaagtgtctggcaaatagtaggtacttaaaaaatttgtagaatgaacgaatatatggcaaaacattattgatgaatatttagatattttccattttcactattccaataatgaattttgcaattagtattcttgcagatatattttatacatgtatttatctttctagggcaattcatagagaaggaattactgggtcaaggaacaaaaccaaattaaagaactctaacccctctcaaattcgtcccatgttcaggaagtacccaatgtgaagggaggtggcacttatatttacaaacccagtctccctagctatcacttgagtgctaccactgaaaatctcacgaatgtagtcctgttactaagtggcattggctttttaatttgttctgttttggggaagttgtctgagtctcttatgtttctacctcatgttctgatccattcaactgtcattctgttgaaatgagaacagtaccttttgtccctgctattttttgttaagcaagctatattggctacaaaactttgtgctcccaatatctttatgaactttttttctaatctggctttgttaaaatcatcccattaacccccaaggctcagggtaaatccctatggaggaaaggtaagggctcacatcattcattttatgccaatattgggctatcctcagaacagttctaatcctctgacgctaaccaaggctccttgaaccaagttttcaaagctcagttctttcccatcttcagtcgagtgacttgcaaacatacccttgacaggtctagtctcagtcctgtagatgtttctgaatcccagggtaaaatgtcatttgggctgctcaggtagggatcctagaaatactcagatatattcataaatatagaaacagatgaacaggggtatgttcaaatttcatatcagcaagttttcaagatagttcagggttcccccccttaaatcctaaaactttaatattttaatctttggggtagaaggcttcctttatagaatattcttttctgattacaaatgtaatatatgatcatttagaaatgttcagaaatagaggaaatataaaatagagaaaataaaatcacctataacctccttcccagaggcaccactgtgaaaattttatacacattttcatccaaactcttttctatatgtttttacatagttaaagtcatattgcatatacttttttgttgttgtttgcccttttcttcataacaaaacttttcctttttgactacaaatgctcttcatatacatactttctaataattgtatattagtccactgtttggatataccacatattatcagggttgtgtgttttaaaagctgtcttgcaagtttactcagaataaaaagtcagtcatattttctttcctcacccagatccactcagtcctgagtgctgtctattctatttccaaacagtttatctgtcccagaggttttaatccaagctggaacatctgggaagcttttaaaaaatactgattgttggggtcctgccacagactgattcagtcagaatccctgagggatagacctcaggtattcacatacctaaaatctccccagtggattttcatatagccagagttgagatgaagtggtcaggccagccccttctctccagccccactgccacatccctaggtggagccctccctcaactcccaattaggcaagtgcaattacctcctaactcttttcctgtttctcgtctctttctctggcaacgtctcatccttcatactccttcccaagttactttcctaaaacacaggtcagatcacatagctcccctattgagagaccttccactgctccctactgcctacactggtgagtctaatttggcctgagcaaggccttctaccaccacagcccaacctatatttccatattttttcctcctctaggtccttgtattagtttgttttattttgctgataatagaatacctgacactgagtaatttataaagaaaaggaatttatttcttacagttatggaggccgagaagtccaaggttgcagagctgtatctaataagggccttcttgctgatggggactctgcagagtcctgaggcagtgcaggacatcacatggggagggggctgagcatgctaatgtgctagcttaggtctctcttcctcttcttataaagccaccagctcccctctcattataactcattaatccattaacccattaattcattaatctataaatggattaatcccttcatgactgcagagccctcatgacccaatcacttcttagaggccacatttctcaatactgctacattggggaatacgtttcagcatgattttgatgggggcattgaaaccatagcagtgttctagtgtgccttgccacttttcttagcgagctttctgcttttgttcaaactgccttttttcacactgttcctaacctgtaatgatctccttctccaatcctcaaagaacaccatcatagtattcatacttcaaggcccatttctaatatcatatccctattcaactagtcaacaatcatctattgagggactactgtgcaccattcattagttcaacaagtttttgagttctactgtatctaggtgctaaggagataagagtgaacaaaacagacagaaatacctttccccgtagaacttacattttagtaggagacacaggaaagaaaaaaacacctaagcacattttcataaataagaaaatgttagataagtgctatgcagagaattagaacgtatagtgactgggtggctattttggtttgaaatagcctctctgaggaggtgacatttataccgagatctgaatgacaggaaggaagggaccaatcattcaaagtttagggggcaaagcattccaaagagaggatcagccaatgtgaaggctctgaggtggaatgaagcctacttgtttgaagaacagaaagaaggccagagcagctgaagcacagatccaaagggggagtagtggcagagagagtcagagccagcttatatacgcttttgtggttgttgttgttttgtttgttttgagacagagtctcactctgtcgcccaagctggagtgcaatggtgtgatcttggctcactgcaacctctgcctcctgggttcaagcaattctcctgcctcagcctcctgagtagctaggattataggcacatgcccccacacccagctaatttttgtatttttagtagagacagggttttgccatgtcggccaggctcatctcgaactcctgagctcaagaaatccacccgcctcagcctcccaaaatgctgggattacaggcgtgagccaccacgcctggcctcatatatgctttctaagtcagggcaaagagttaaaatttgattccaagtgcaacgatgagaagccactagataattttaagccatagagtgatatgaaatggtttgtgtttgaacaagatcactctggttgttgtgtgaacaagagatagagggggtaacagtaggaggagggaccaggtagatgctttggtagcagtccagttttccttgaactacttgctgaatttgaagcaaataaaaagcaaacacttctcttactcttaggcaaaagattaaaattcttaatgtcacctaaaaagacctggatgggctggcctctctccagccttctctataccttcattgcctcctgctattgagccttgctgaccttccttcagctccgcaacctacatcattccttcaggccacaggacacttggacttgctgtggttacatattatttctgtgtgttataaaatacacataacatgcaatttaccactttacctattttaaggtgtacaattcaacattaagtacattcccactgttgcacaaccatcaccactatctagctccaggacttattcgtcaccacaagaataaaccccatatccattaaacggtgactctccattagggttagcccttggcaaccactaatctgcctatggatttgactattacggacagttcatataaatagaattatacatatgcatccttctgcatctggctttcgctcagcataatgttttcaaggttcatccaagttgtatcatgcatcagtacttcatctctttttatggctgaataatattccctagtgtagatatgccacaaaatagatttcattaatctacttgtcactggacatttatttaggttgttttcatattttggctattgtaaatggtgctactgtgagttgcttggtgatatggcagctgtgattatatattgatgcattatagatcagtgaatcttagacacgtgatagtttcctacagctgctgtaacaaagtaccacaagctgggtggctttaaaaaaaacagaaatgtattatctcacagttctagaggctaggagtctgacatcaaagtgtcagcagggccatcctctctctgagactctgggtagaatccttccttgcctcctcctagcttctggaggtgaccatcaatccttggcagtctttggcttgtagctgcatcactctgatctctacttctgttgtcacaatggccttctccctgtgtgtctttgtgttttcctatggccctctccctgtgtctcttcttttaaggatatgagcccttaaaagtgcttggattatgggcccccactactccagtatgaccttgtcttaattatatttgcaacaaccctatttccaaataagatcacattctgaggtactggggttaggacttcagccgcacctagcctggacttcaatatatcttttgggaggacacaattcaatccataatacatgacagacattactgtgcatctgactcccctggagatcttgttaacatgggcttggagtggggcttgaggttctgcatgttcaaacagctcttccagtggatgtcaatgctgccagctcagggttagtgtgactaatatgttctggtttgcgcaaggccttcctggttttagcaatgaaaatcctgaatgcagggaaacccctcagtcctgggcaaactgggatggcttgtcaccctatatatatgtcatgggccacaattggagagcaaggatctagctacaagctatgttaatttatctactaattacattactgaatattcatatttatctttatatttaaatggtttatttttgctagaacagtccaagttttcaagaatctggacctaagagatattccaaaaatgctccaaactgtgagacggtgagttagcttaaactgatgggtgtcttctgtgaatgtcatatattaactcaccaaattatctatgatgcttagcagtgtcactgttgggctgaacattgagatttctgacctctttacaaaataattatacatggccaagatcttttgatgctaaggatacccactgggcttgaagtcttcagtatcctttccctgctgctgcagcagttggaatcagcctggagtctgtaagaatgaaagagaaagctcctctctgaagttgggtttaagttcattgcagtatggggcaatgcccctcaactcttgcttaatattcagaccacctgaagagcttctaaaacgcggagctttcaccccacaccaaatgactccaaatagctgggattgggcacaggcattcataattgttttaaaacaccaggtgatgcaaatgagcacccagcatcgagaatcagtgtgccaagacccctttataacagacaccttgctcaacctgtcccttctttcacctgcacctatattccacccttgtatgcccacatacctttttgttatagttgacaatttccttaaacaggttctcctcttcctcatatttttgtcctgttcatacagttaccttattgacctgagaccacatataactggatagaggtaataattactcctgtaacaactgaccttagcaggcttttcccaagccttattgactctgtttttcactctttcacaaatatgtatccttaacatcatcatccacgattgagttaacctgtgatagtgttgctgtttttgactagtctcttagcaatcaagctaaatctcccactgaatctgtgtgttcctctacaaaccatatctgggtggaatgtacgtttttattgtgatataattaatatatcataaaagtcatcctcttaaagtatacaactcagtggtttttagtaattcacagtattgtgcaaccatcatcactatgtaattctagaacattctcattactctaaaaagaagccgcttacccattaaaagtcacctcattcctgcctcccactcgctgcaaccactaatctcttttgtctctatggatttgtctattttggatatttcctatacatgaatcattcaatatgtggtcttttgtgtctggcgtctttcgcttagcatattttcaaggttcatccacgttgcagcatttaccagtagtacttcattcttttttgtggccgaataattttccgttgtatggaggcaccgaattttggtcatccactcatcagctgacggatatttgagttgtttccaatttttggctattgtgaataatgccgctataaacattcatgtatatggttttgtgtgggcatatattttcatttctcttgggtaaatacccaggaatggagttgctagatcatatgcaaactctgttcaactttttgaggaactccaaattggttgtgaacattattttttgacctcaatgcagctttcctttacaggagggaggtggactgtacttgttagcgcgctgcaaatgattctcaggcatattaaacatttttctgtattctgttaaacattgtatgcgcagcaagaatgacgcctcatacagacctttcttgtcatttcgttttattatttcaaaatgtaagacaaatctgaaaaatggaggagcctgcagatacctgtggtggcgaggatttggggtctgtctgagctccggcgttcctgcccatccctccagctgtatctctggccacctgtctgttcctggcacaaacaaggcctgctggttgccaaggacatgactacggggccatttccatgtgagaaggccctggggggtgtcaaaatgcagaaacgtgactgatgggcagcggggcacccataaacttcccatagccaggtgcaggcatacctgcaaatgtaacgcccaactgtgtacaaagcagaaatctaaatgccagggcggactgggagaggttcccgtgacctctgacccggcctctaaattctcccattccctccccactgtcctgccgcgccccgtgtcgcctcgcctggcctcgcctggcctcgcctccctcctccgctgggggtctaagcctgcgcagtattgcgaacgcgggcggcgtttcccgcatgcgcagtcactgcccggcccggctttttcagtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaag

SEQ ID NO: 3316 - DNA, 2276 bp, human
cagagcagggactggaacttaggtgtgtagttctgccgacgtcaaagtccatactacagattttttgttagtttgtttctcttttgcaaaggaataaatcaaggactggaccgggtgcgtgcctgctctgctgcggtttaggatggggcttgaggttctccttccaggatcagctgatgggagagcacaaggcacagaaagttctctgtctcacccacagccatggggatccagctgtaggttcctgcagccagatttcctcatttcctgggttgttctcaaccaccccaaagataccacgaccagactggagcctcttccctgtggcttggcatcgctggatcctggcatcaggacagggtttctaggctgcccgcaggacggatctggtttctttgaggcatttgagtaagcctctcatagttttgtttgtttgtttgttgttttggttgtttagttcttgttaaatcagtaaggcaatacgttgcccctttgctgtctcagaaagatcttagctaaggcaaattttagttggagttgctgcattaggttgtgcagtttgggcactgtacaaaggcatccagaggaaggggcaagtgggagccaaaatccaaatgcctttgggttcagggagctttgcgtcttggcaggggccacatccactagaagggcatctttctctctgccacagtagtctggtctgatagctaggctaagagccctgggggcactcacctagaagttctgaatttgtttatccagaaggagtgccatttcccaattctcacaaaagccccagacttgaacgtccatcttaccctctctagcacttggggggacttcgctccatctcctgtgggtttctccactgctgctacctcttcagggaaccaacaacccttaaataaccccctagtcgcaaggaaatgggggaggtcagtctattctgtggcctccatcagaccagactttccagggagtcattctcaaccttgtttatgtgggtcacctggggagcttcatgaaaataccatatccaggctctacctcacactaataaaatcagaatctttaggaatgtgacctggagtttgaccagatgcatatttttgtctctccccaatccgctaagctccacggtataagttttagtataggataaaaattctagaccaggagtttctcaacttgggcactattgatatttggggctagatgattctttcttggggagggggactgccttgcacgttgagagatgcatcgatggcctctatgcaacagataccactagcaatccccctttccccagttatggcagccaaaaaaatgtctccagacattgccaaatgtcccccaggggaaaaatgcccccaatagagaactacttctttaggtctgtaaacaagggttaatgtgcaccccaaattccaggtccaggatagcctggccagcagccttcctttcctatgtcacctctgaagcaatgtgtcttcaccacaaccagtatacattctattactgggctgagaaggaacttctagctcacttctatccactgattctggctggattacaagaaacaccacacttactgttgacttgctctctggcctttgaatgtcctcaccacaaagaaagaaatcagaaatggatgaggtgatggtcacgcaaaatactgacttgacgcttggtgcagtggctcatgattgtaatcccagcactttgggaggccaaggtaggcggatcacttgaggtcaagagtttgagaccagcctggccaatatagtgaaaccccatctctactaaaaatacaaaaattagccgggagtggtggcacacacctgtagtcccagctactcgggaggccaaggcaggagaatcacttgaacctgggaggcagaggttgtgccactgcactccagactgggcaacagagctagactccatctcaaaaaaaaaaatactgacttgattttttctttttctttttcttttctttctttcttttttttttttttctttgacagggtcttattctgaatttgaatttgtttatccagaaggagtgctgtttcctggctggagtgcagtggcatgatcatagctcattgcagcctcaaacacctgtgctcaagcaattctcctgcctcagcttcctgagtagctaggactacaagcatgtgccaccatggccagctaagtgttttttgtagatatgggggtcccataaatatgtacatttacaatgtgtccattaaaaaaataaacaaaaa

SEQ ID NO: 3317 - DNA, 71588 bp, human; identical to SEQ ID NO: 3310

SEQ ID NO: 3318 - DNA, 71560 bp, human; identical to SEQ ID NO: 3311

SEQ ID NO: 3319 - DNA, 71588 bp, human; identical to SEQ ID NO: 3310

SEQ ID NO: 3320 - DNA, 72101 bp, human; identical to SEQ ID NO: 3313

SEQ ID NO: 3321 - DNA, 71588 bp, human; identical to SEQ ID NO: 3310

SEQ ID NO: 3322 - DNA, 1338345 bp, human; identical to SEQ ID NO: 3315

SEQ ID NO: 3323 - DNA, 1338345 bp, human; identical to SEQ ID NO: 3315

SEQ ID NO: 3324 - DNA, 51062 bp, human
cacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtaagtgatggtcagagacttgggtttgatttaggaatcatggtgatgcataaaactatattctgcagtaaggcctctttctgcagaatgtagtgccacgctctgctttactcttatttgagacagctgcctctaattccagcaaagctttcatttctcagtccttctgtaatcagatttcaccgtgtgctgtaggggaagccacccatggcaggtataacagactaaacgttcttgacatctttcgtttgtgtacattctaaacgagcaagtggctgaaggaaattaggggaagtaatttacacagggccttcagcttatatttgggcttgctataaaacaatatatcactctaagatgttgagactaatcagttcttttgaaaaaacagactccaagtagcaactaataaatactgacaaagctgctgcaaagacgccttatatgtgatggggataacgacatttttaaataaaatacaagtttgaaaaccatccctgaaattcttgctggcatgtgcaaagcaggctgtctccaatgaattcattataaaagtttacatcctgcttacaaccattgtgcatgtggttgaagatggcatggagtgtgtctgtggggaagggaaaggggaaggggaagggaacaggggagatgagttagctgggtaaacaaggccatcaggtggagacatcactaccagaaagcttctagaacagtttcatgttaataatgagacagaatttcttcagagcctctttataacctaaagcaaccttcccgacttccttaaggaagaagcttttggtctgaagttttcttttattattagtaagtggacctgtgatagtggccctgggcatcccttctctggagcagctgacagttctaggttctctggactccaccattagcactacttctttagtgaatataaggctctcagaagtcagaatgataccgtaaataatattgtaaattaagcccataatattagacctagttgagacctcagagccatgaaataatgccttctcttattttattttgggaggaaatgtgatttttatttcttaaacagctcaaatattcaattgaaattgtttcacttctcttatttcaagtataaggtaaaaaaagcccagaatgactgtggggtttaccaattagtgccagagttagatcagataacaacctggagaaaagtttaaagaactaggttcaaggcctagcaccacccttgctggctatatgaccttgaacaagtcactaaacttttctgcaatgttgtttcacctataaaatggaaaaaaggataatacctgttctgcctacattacagggtggttcaatcattccttcaacaaatattaattgaacatctactttgtgccatgccctatcaaggagttggagatacggtggtaaataacgtaaaaatatacttcactccagctacatgaattcatagtctagtgataatcagtgagataatgtatatgaaacctaaaaagtgacagaccaatgttcattatttattttagtattccattacactgagttacatcagataaaaatgtgatgaaattttattctatagcttttaacaaggaatcatcactgagttgaaaacacccaactgaatgaataatcaaagcctggaacttaaacttatactgttctttgaaaactacaatgataattgatttttaaaataattattacggattaaattttgcaagtaaaacctcctccaaacagttgaactttttttttttgtatttactaatacactactgtctatatccagtagccagactacatttctgaaaatcctggtgagctatttctcacagtgaatgggggctggcacaaaagtatggctaaatcggcccaaatccaaactttctatttgaaagtgtgaaagcctcgagtcacccatgttgttagaaactcaatagtgtgaatctctattgaaaaatgagataatgttgaaatggtttcgacatgcattctcacgtggcataggtatttttctttcctactgtattggttagttgcactacctgtcagctagataaattcagaatttctggtctccaataagacttacaacctttgacaaagccctcaacaacagagaaaaactccctgtcaactctgcctgttctatatttttgctttgattttcagcctttcacagggattcgagttatttttttctcccacatctcttgggaaaggtggagggcccttgttatgtaacataccacgtgagtttactactccagaataataggaaatatgtggttagaatttgatggtgccacaaaataggaatcgcagttttgaagtgagcggtcatatcgccatggacatgataaaataatagcttaagtgaggctgaagccatccacacagcccctggatcaatcacttttagtcagttaaatttttttttaacaagatcgataggatcagaaaccaagactgctgaaaacacccaattcacaggctttccatgtcataaacaaggctctaaagccttgctgtgtttggataatagagaatatcctatgatttgttgcctattagggaaaccacttaaagctttttaagaaaccactaaaaaaaaaatctctttctttatcagaaaagaccaatttgtaagtgcagttcaatttcatctcacaaatagaaatttcttcagagaatattgagctaagctactcaattctgtggaggttatggattggagccagaggtgactagttttcaggtgtttcattccagacctctgtaagggctcacataactcattatgctcccttcgtctctcacacatgcccatccatacacacgtggacatccagacaacgtgattataagacgttcatgttcttgcatagaggagagaaaccagtgcactttgattattcacaatgtcgaaacttaaaatgaatgccttttaaaaacatcacttcagctgggtgcagtggctcatgcttgtaatccctgcactttgggaggccgaggtgggtggatcacctgaggtcaggagttccagaccagtttggccagcatggcaaaaccctgtccctgttaaaaatacaaaaaaagaaaaagaattagctgggcctggtggcatgcacctgtagtcccagctactcaggaggctgaggcagaagaattgcttgaacctgggaggcggaggttgcagtgagccgagatcgcgccaatgcactccagccacctgggtgacagagcgagactctgtctcaaaaaaaaaaaaaaaaaaaaaaaaatcacttcacttcagaaaaccatacaagagatgggaccaaaagttgaatggggtcatgatgttttccttggccaacagtggaatttgtttcctagtttatttttagtaattgagtaacgtaacttagataaaataagccactgatttttgagtttcaggtttccagatctttaatagtaggtctgcagaaagctagccttcatctgaattcttcaattttcagatgagaagtttcacaattttagaatattaatgatctaaggtatcttagaaactactagtcactcagtgctcaataataatgttgtagaaaaaactgagttcttttcacatgaccaggaaagtttaggctcacagacactttgaagggtgagggggagcggaatttattgagtgaaaaggaaaaaaactcagcaaagccagaggggttcctgttaacaggcccccatctcacagactgaatgccaggttaccacacaggaacaggagaggcctagctcctccccactccaaaaggtgcagtgcgaacttccccaaggccccaccctgtcctcccagtgtgcaggtgggcattattcagaaagaatcagtcaggggagtgtggggaaagggcgggcctcatccgggacaggcagtcctgttcatcagcctacaggctgttttaggcttgaacgtggggtttcgctgggggtcgcgggtttgggggcccttggctgccccttgtctctatcaataatttatatcacatatgggtatgtggcaacagtgaggagggtttcaagtaaacttttattaatacattattattgttattgttaataagcataaatttggaaaacatttgtgagtttttttcacatcagtgggatcactgcaaagtttttttttgtgaaaatacagctcctttcttttgcatgcattctaatatgcctttttgagaaggaaagaaagggatagaattaaagttaggccactgaaaattcatgtggctccagtttacaaacttcatgagtgtgggggaagacatagacaaagagaatcgctaatttcgttcactttattaaattttcaggtgaagaattgaggctcgagatggcaaataaccttcccaaggccattgtttattcttaaatctgggctgaactaggactacaattcaaatatttaaaggcactgctcttctcatttcattgcttgtattactttgatcccttccaattgatcaagctggccaatctacctttgcctaatatccttttttaggtacagccagaatatctcagtaaagaaaaaaaacatacacaagaaaatatgccttagctcttgcattaatgcaaggttaaagaaacataaaaatctcagccataaggcccattggccccctcttatgtctccagaagttaaagtctttatctcaaattgtccatggggatcagagtatcatttaacactgaattttttcctactctggcaaaatcagtttctgactgaccacattttactcaaatcaagcactttctcttccaataaaatacaattataccaggaatacatccaagtctctcccaccccccagtttaccagagttggaaaatgcagacactagcaatgaaaggcttcattctgcaagtagcaaatactcttccattttgtagctaggaagatatttgggtaaagttaatacaaggatctcttattaccttggcttagcttcttagcattcagtgatttggggttaagaaatctctgtaattattttttcaaggaataaaatgaatataaggaactagacttgcctttttcaagggctctggctctgaccagactgcagtgacagttttgatggagtatttgtacgtgcttctcattgtttcccacaacattgtatcctccctcttatgtgcagcctgaataataataatgtggtttgtgtctggtgtaccaaggagatttcttgtttactctgatttacttcttgtacactttggtacaagaaaagcaagcattttacaggagactcgaataatgcatttggccctggttctggtgcttgtgaaccagagcaggctgcctcctattgaagaatgaggtctctagggggaacttaatagccattgatgccagcagtcttacctggctaattcaagcgtggctttatcacccaaaagcaagaaaatgcttgctacagaccagaaaaaaaaaaaggaggcctgtgtcagaactgttttaatgtggtacaattgtggaactcttctaatttttatgtagcttaggaaagaggtgtggcaactccattttggagccaaggggaggtctgtgaggagacagtaaacaggataggaatttaaactgggaccattgtatttgctttccttccagtgataaatttccctggttagttctcgatatctatgaaaaacagctctttttcccaagctaacatttcctgccccacctcctggatggaattgagaaaggtggtgactactctaatgatttttcagtggtataaacagcataaccccccctcactagctgtggtggaatttttttttttttttttttgagatgaagtcttgctctgtcacccaggctggagtgcaacggcgcgatctcagctcaccacaacctctgcttccagagttcaagtgattctcctgcctcagcctcccgagtagctgggattacagacgtctgccaccatgcccagctaatttttgcatttttagtagagatgaggtttcaccatgttggtcaggctggtctcaaactcctgacctcaggtgatccagctgcctcagcctcccaaaatgctgggattacaagcatgagccaccgcacccggccagctgtggtgcaattttaaaagaaattctagttaatcactcaagccctcagatgctggtatgaccagatatatagcatctacctctctaccgcttttgtccccaagaaccctgacaacttattctgtccaaaaggagtttgtggcaagaaagaaccaaagtatcagtgtagtccactattactgtacttccatttcagccttcatggtggtatgagcaaacattggccctataaggtatacttgccagttttccaggttttggcccttgactcatagtgctgtgcttaggatccaagattagtccactcttgtttcacatacatatgtccagtcattgttcccagtagtgcaaatactataccagagtggtggggttctaggggatttcagctttagcaacacactaggccacagtcaattatcctccatgattttcaggccttgtgttcagcctgggccataccctatatttgctcttccctcaacataaattttgtcttttttttttttttctgagatggagtttccctcttgttgcccaggctggagtgcaatggcaccatcttggctcactgcaacctctgcctcccaggttcaagtgattctcctgcctcagcctcccgaatagctgggattacaggccctcaccaccatgcccagctaattttttgtatttttagtagagacggggtttcatcatattggtcaggctggtctcgaactcctgacgtcaggtgatctgcccgcctcagcctcccaaagtgctgggattacaggcatgagccaccgcacccggctgaagtgatgttttttaaaaggcattcattttaagttttgacattgtgaataatcaaagtgcactgttttctctcctccgtgcctggcctatgtcttttcttatcatcagaacttggtcaggatgttgaaaatccatcatgacaaatctttcaatattcatcccagaaatctgctgggaattaattctttctttcttttttttttttttgtttttgaggcagagtttcgctcttgtcacccaggctagagtgcaatggtgcgatctcagcttactgcaacctctgcctcccgggtttcagcgattctcctgccccagcctcccaaggagtagctgggattacaggtgcctgccaccacgcccggctaatttttatatttttagtagagacggggtttcaccatgttggccaggctggtctagaactcctgacctcaagtgatccgcccgcctcgtcctcccaaagtgctgggattacaggtgtgagccactatgccgtgcctgaattctttcttatacaaattgatttacttttgccctaatgacctactatcatttattcatttacttaagaaatatttattgaatgactactacattccaagcactgtactaagcaccgggtatatattagtgaataaaataggaaaggtccctgctatttgtggatcatatgtaatccagtgagaagagtaaaagtagcaataaataaacacataaatatatattaaaattgtgataattattacaaacaaaatgaaggtaaagtgaagactacttagacagtagagtcaggaaaggaatctcttaggaagtgatatttaagcttacagcctgagaatgagaaggagccagctttgagagttgaggggagagtgttctggacaaagggaatggtatatccgagtcctgtgatgggaaagcttttggagtacaggcagcccctcctttgcgatatcccaatgtgcacaaatttcaattaccacagtttagttaataacactaggccactacgaacacagttcaaatttcagtcaacatggcatattaattatgagtaattcataaagcaaaacttcattgctaactcttcagtctacaaatcaccatgtaaataacacatacacagtacctcatggtcagtgaccaattacatcacttctttcaaagtctgttggtgattggtcactgtgcatctgtcattcagtttgcatacagacagcaaagagtatatagctgtgctgcctccttttctcccagtgataaacccatgggcattttacaaaaatggataatgacagtgcagtacatgaaagtgcagcagagaaataaaaagtgcctttgggaggctgaggcgggtggatcacctgaggtcaggagttcaagaccagcctggtcaacatggtgaaactccatttctactaaaaaacacaaaaattagccaggcgtggtggcagacgcttgtaatcccagctactcaggaggcttaggcaggagaatcgcttgaacctgggagacagatgttgcagtgagctgagattgcgccgctgcgctccagcctgggcgacagagcgagactccgttaaaaaaaaaaaatactgatagcagtggaagttaaatttggattgaatgtaaatcgagttatggaagaaacagctgactatgtgattgttaccctgctgctgtttgagaggctgtagatatacagccagaggaacttagtgaagacaaagttattgacataactgcagaaagtggttgtgacaaaaaggatgaagatgtcccaggggaagtaacaccagcaaaacacttcacattaaaggaactctcacagatattacacagcgttcaaagtgcaaaggaaaatgttgaaagtttatccaaacttagaaagaattatgacagtttaccaaaacatagaaaagatgcttgctctatatcataggttctaagatgagaaagcaagcactgttcaaattactcttgatagagtttttacaaggaaataaagcactataattctcaatgcttctaatgttttaaattacattgtactaaaaaatacatcagttttactatttttcacttccctacacatttacaactgacaataaaagtttttaatgttctgacaattttttaaaagtcacagaacgattacaattttcccactaaatattaaggttactttacatggcttcagatttaatggctattcacagtcccacacactaccatgcaaattaaaaactgcctgtgtttaaaaaaaaaacagttttggaggacattatgctaagtgacataagccatgaaggacaaatactatatgatttcacttatataagaatcaaaaatagccaaactcatagattctaatttaaaacatcagacaatactggttgtcagaagttgggagtgggggaaaaggggagtttttctatggatctaaactttcgattattctagatgaataaattctagagatctgctgtgcaacatagtgcctatagttaacaatatggtgtcgtgcagttcaaaatttgttaggagactagatctcatgttaagtgatcttactgcaaaaccaaacagcaaacaaaaacacaaaggggcacaaggaaactctggggtgggggaaggttatctgctaacatttattggagatgtgattcaagggcagcaagagtgagggcagcattatcagctgctgccatggaaagtctagagtcagaaagggagatttttccaatcacttgtagtccaagggaaaaatattgaaataaagtttctgttctatatacatttgaaaatcaaaggccttgacaaaaaggaaagcttcaagcaggatgtttgtgtgttctttctacctttatattcaaatcttctgtcagtggagaaatagaaacagcagcatctcacaatgcaaacccacagcagaacattaaccctaaccctaactacaagcttaatttcacttccaacttagaaacttctaagtatgtaggacaaaagctgaggaagccccagaaacttgttactttctccagtctgtcttctattggggataataagaactggaagctggagcttttggagtagtaaaaggtaaggtattgttggtcctcctctttcctgtttccttttatggaaattggggagaaaaaatttagtcctttgcaaaattttcatttccacttctatttctctgagattcaacaagaacaacacaattctaagatctatgacattctcttaaataaagcctgtagccttgtgagcattcagaagtaagaggatacaacaaaatcccgcagaggctgagaataggggatgatattgaatcctttaagtatagcagtttggagactcagcttttgtgggctccaaaataaccaggagtctgagcttgaactcaagacaaaaaattgagggcctcaaaattagttcatgagtggtttttcctgtggttgatggatgtgagttcaacagctatagtgatgtttctcaaattccttgaaacagagggagtggggttttccagcaaagtattcttccccttttaaaataatattagaggaagtcttaagccaaggaatatcaatgtgttattgtaagacatgtagtcaagaaggtttatcttctgtaattttatgttgcttggatcttattccagaagaaaaatattttcaaatctgccccaactgtgaattgagaaagattaagctgccgtgccttcatttcaggccacatatgcaaatctgttttataatccccagaagaagatttcagttgaccctgaaaaatgcatgactgttagtcagtgcttactccttaacattatcagtacttagtattccaagtgttgcttaatattatcactaattaatattatcagaagaaaacacataaccaaaatttgtacgtaaatacaaattttctgtctaaatgccttgcttccaaagttatcaaattgctgactatgatggagatattgggcacagttgtgtaagcattttactaggatttcagtagaaggaagaaaatgaagggctgtctagaaactgctttagccagcaaaatgtctttgtatatctacaaacttatttttaaaatatttggttctttgccgggcgtggtggctcacgtgctgtaattccagcaggttgggaggctgaggtggttggatcacctcaggtcaggagttcaagaccagcctggccaacatggtgaaaccctgtctctaccaaaaatacaaaaattagctgggcgtggtggcacatgcctgtagtcccagctactcgggaggctgaggcaggaaaatgtcctgaaactgggaggcagaggttgcagtgagccgagatcacaccactgcactccagcctgggtgacagagtgaaactccatctgaaaaaataaataaataaataaatataataaaatatttggttcttcttagtctaaaccttttaaatttttattttcgtgtatgttttgttatgtacataatctattagtatagcagcacatataaacaaataaaacatacattatgaatccatgtttaaaagtttttactgttagaggtacgtaataaaaagttgaggaccactgctttaaagaaatttccatttggagagcccatgactcacatatttttaaaagtcaaagacaataatacatctttgaaatagcaatgttaactaaaattttgtttctacatataagctgaaaacagtaatttctatttgtagttgaatatgtcatcaatgtcttagattaaatcagtcaattggctgggtgcagtggctcacacctgtaatcccagcactttgggaggttgaggtgggcagatcacttgtgctcaggagttcgagatcagcatggccaacatgatgaaaccccgtctctactaaaaatacaaaaattagccaggtgtggtggcaggtgcctgtaatcccagctactcaggaggctgaggcacaagaattgcttcaacccaggaggtggaggctgcaatgagccgagatcacgtcactgtactccagcctgggcaacagagcaagactccatctcaaaaaaaaaaaaatcagtcaatcaaccaattagccaaccaactgacaaactcttaatccttatggaaattctcttccctactaactagacctctgaagggctcagtctcacaaaatgtctaccaaaaaatatctattcacccactgaacattaaatgaaccaatcaactctgcaagaaacatatgtagtgcaatattcacttgtctaagttactgacatcatgcagtggaaacaacaaattgagtgaatttgtgcttttcccacctataagcttatcaccattgcaaaaagacctccataaatcccaacagatgattaactcttcatcccaagtagcacaggctctcttgttaggttagaattaaagcatgatcattttgtgacagttattttacttctagtaaaattaatgtttagtacacgtggtgaaccacaatttgcctttggctgtttataatttcgaatggtagaaaataccaattattgttaaacacagataacactaggaatgatgagagaaagatgatgtccattttatagaatgattaccgcaaataacaattattgtcatcacaatataacaaaatgttaaaattgatctttttcggttttggtttctgtccaggcccagtaggtactgattcttccctcattctaaagagatgctagaccactaaaaatggaattgcaaaggaaatagacaaaattcagtttggaatcccttagttaccaccttcagcttataaaatgtgttgcagaaaccaagagaggggttggaaattagaagataatttatagagagtgtttctattgtgtatcatgtgcctcctcccccatgaaggggatactcttccttcacttcaagcccaacaaaatggctccactagggcccacagtaaactgatgtcaggatgatacctgagaaatttaaagtaggaaagacaggctagttagctgttctgatagcagaacaagatggagtctataccaggatggacctgacacttgttagagcaaagaacatggagaacttcccatgaagcaatagggaatgagataaaaaagacctagcatggtattgtttcagatcatgaccaagagacctcctggaggggtgggggaaatctcagcaaaatagaggctggatgtgttcccttggatgccagaggaaatgtaattgtctgtatcaaagactgctatgagaaattcctaatgataagcgggggttctccaaaggacctccaaaaacacatcacaagagagtcaggtgttggagacacgtgcaccaatgctagattgctagagcagaaccaggcttttgctggctcttaactcctcaccttcccttggcttcacttagaggaactgaaagtaaggaaacgaggaaatagcacattggcccctctttccccatagaggaggccagctttaatcaggcataagctggaagggaaaaggtgttaacctgcagcaaatttcttaaggtttttttaaaatcactattattattattatatttttgttacatgttattttactgagactctttgaggtagtaaaataagcagagggctttttgtatttttctgagttagtagaaaagttacagcgtccattgtattttcatccagggataaaaagaacaagctccaagaacagatttgaagggcagtagggggaaaatacgaaattattttctattgtgcattacaaatgctgcttgtacagcccaatgattttaataataatagctaaaagttatcaaatacttattatattccagacaatgtctgctttacatgtattaaataattttatgctcacaacaactctataagattattatagtaattttctaggtgtgaaatttagaagcagagagtgggtaaataaactgccctaggttgtgtgactagtaagtgacaaagccactcatgtggctatttcaagcaaataaaaattcaatctcttttcacaaattctttttttttctgtcaaacatccaaaatactggacatacaaaatataaaccaaggccatatcaaatttcaacgcattaacactttgcagagacacatgaggttatatgtgatttgctgtgctttatcaagaataagaagataaagcatttgctgtgctttatcaagaggccgaggcaggcggatcacttgagctcaggagttcgagaccagcctggtcaccatggagaaaccccgtctctagtaaaaatacaaaaattagccaggcttggtggcatgtgcttgtagtttcagctacttgggtggctgaagcaggagaatcgcttgaacctgggaggcagaggctgcagtgaactgagattgtgccacactccagcctgggccacagagtgagaacctgtctcaaaaaaaaaaaaaagaaaagaaaagaatgccttatcaacagtaaaacaatgaatcaccatagtacatgggtcttttctgaaatacatatttctcccttttaaatctctttttacaggtgtggacaaccactacaaaataaagtgcagctgaagggccgtgaccttctcactctaaaaaactttaccggagaagaaattaaatatatgctatggctatcagcagatctgaaatttaggataaaacagaaaggagaggtatgtaacattttctttttacgttccattactaccagtcccctttttttaaaggcagccttcccaaagaaagagggaaaaaaatacattaaaattcttaaacagtagctaagtaatgaaacctcacagtcaaggtaattgattatcatggagcatacaggcatacaaaaaagcataaaaatcagttattgaatgacaagtcattgcacttttttcacgtggaatgctgaaattcattattaactggatcgaacctaagaaatcatttgtctgaaaagcatttatttatttatttatttatttattgagatggagtcttgctctgttgcccaggctggagtgcattggcgtgatcttggctcactgcaacttctgcctcccaggttcaaggaattctcccgcctcagcctcccaagtagctgggattacaggtgcataccaccacacctggctaatttttgtatttttagtagagatggagttttaccatattggccaggctggtctcaaactcttgacctcaagtgatccgcccaccttggcatcccaaagtgctgggatcacaggagtgagccaccgtgcccggccaagattttatttttataccccttttcttttctctgtgtattttctatcaagtcaaaaatgaaggccaggcgcagtggctcatgcctgtaatcccagcacttagggaggccaggcaggcaaatcacctgaggtcgggagttcgagaccagcccgaccaacatgaagaaaccccgtctctactaaaaataaaaaattagccgggcatggtggcacatgcctgcaattccagctactagggaggctgaggcaggagaattgcttgaacccaggaggcggaggttgcagtgagccaagatcgtgccattgctgtccagcctgggcaataagagtgaaactccatctgcaaaaaaagaagatgatcctttttttccaagtgacaaattttaattttggatgcatatcagatatagaatcattaggataatgtcaaaaaattcacaatgatgtgacagcgttttaaaaagcatttagattagcaaagaaacaattaatggtatccaggtaggagaagagatgggatatggttcttagctataagcataattctgcattttgagcaatttatcttcgaaagacaattaatacagtagcttcatttggactgcttaattgtgaaagcatttttgtattccaagcttgttcagcctttttaaagagttggtttcaggttgagaaagtttgacacggttttgattttatctagtaggctggctctccaagctcctaagaaaaactgaggacaggagtgaccgcaactgctatgggttgatgttcctataaaacacctgaaataagagaaaaggtctccccaggcccaggcctatgttcttgacactttgtggatgagggaggttagctggcaggaatctatttgttccagaattccttctatcaggaagcccatctacagaagaggaaggaggaagcgccccaccccacattcagactctccagattgttttcaaatgacttccagaagcaaagtctttgtattcccatgaggatgcatgatgaatgtgtagctaaaacactagggcttcatcattgatctaagtgaaagttgtagtgccccatgttgtaacagagtagcattttcccagctgagaaaacacctccaaaccaaacaccttcgaggtcattgaaaactgaatggggatttcaatagagttaagtaagaaggtggttccagtatgaaatactaatatattttggaaaaaattcacatgttgaacccagaacaattaatactgctttctaattacatgtcaataagctgtgggagttactgttctcttcccccatttgtatagtacataaaaaaacattttaaattcacttttttttttttgagatggaatattgctctgttgcccaggctggagtgcagtggcaagatcttggctcactgcaacctccatctcccaggttcaagcaattctcctgcctcagcctctctagtagctgggattataggcacccaccaccactccaggctaatttttttttttttttttggtattttgagtagagatggggttttgccatgttggccaggctggtctcgaactcctgacctcaggtgatccacctgccttggcctcccaaagtgctgggattaaggcatgaaccaccacacctggcctaaattcactttttaaacaatattttaaacacttatttgggggtagttattacttattttctaataaagaatatgttttaaaacataatttatatataagatatattttaattctattcttgtccttgatttatagtatttgcctttattgcaagggaagtccttaggcatgatttttgagaaaagaagtactcgaacaagattgtctacagaaacaggtaagtccactgccaaattcacacttgtgttgaagagagggattgaaggtgaagactttggaggggtaacccagtgcggggatttgtctgcctctagcaaccacaaagaaaaaatcatttttactgggagcagcaatgcaagcctgtgaatgagatttccagttctcataaaagctgcaagcagaaaaattagcttcatctataagaattccataaggaactgagtagaagttccatataactcttcatgttcagaaaagaaatataggtgggcacacattttcaggccttgaactcacgtgggtaagaaatatgtctatttttctagcatgcaaagaacatttccttgtgtgtctcaattctgctagatggtggaaatttaatctttgcgatgttaggcaatcctcagttgttttatggtttattttgtccattttgggtctcctctccatttccccacagtcaggttaaatcatggagagtatctgaatgtcaagacatgtaggggtatggggatctggtccttggtcattagaacatcatcatcaaatatccatgctaggttctgttgggacttctatattcccattggatcttggctgtctcccacttactgcaaggtttgcttcactctcattgaaagaactcatattgagacaaccaagtataaaggggtcactggagaacctccaaccggcctgaacattgggaggaatgcacacggggctgaagcctcaggaagttcacaccatttgcgcggggaagagctggcctctcctgttccgaggtggaaactgggattcaatctgagaggcgggaagacaactagcaggactcttgctctgctgagagtccctgttttccttttttttcttttcacccgataaaccctgctcttctcacccttcaaagtgtctgtgagcctaatatttcacggttttgtgacaaggaccccattacaacaatatatctcttggtttcattctctcaacctcttagcagctctccaagacacattaggcacagaggtactacaaggctgcctctactctattgttccttcctcatgctgggtgccatggagctctataacatttactgccttctagaggtctgtcttaaaagcaagacaggttgtcctcagttctgggattctccaaactcatggagctttccagcatgcccccccatccttcagaagttgacttggggaacacatagcagagtacagtatcaaaggtccatcagtttttatttctgttgcttctcctctcttgcttctcttcttcccctttcagttcccagtattggaggccaggaaataaagcaggaggaaaaactggctctgactatccatggactcttccaaattgtgcctggaattctaggctgttaaggatattttttttcctcaagctattatctctgcagtttcaaaatggacactttgaaactcgtaagccacaaattgcctcttttctttctctctgcatttctgctctaccagacctcacttgaatcaataatatgactgcccaaatgagcaatcagacagggtcaaggaggaagtaccgcaaacaaaaacatattggttgatatttcaaatagattattctaccttacgagtgtcagagctttctagggcttagaagcaaacaactattacatgtgatttttaccttgcaatgattaataatgaagcttaccaaatagatatcaaaaagaaagttcagggggattaagcgacttgccaaattcactcaattaatacagatagcaccaagattcagatctgaagcccactattcttactaatgcacactccttccccctaaagagaaggaaggaggacgagggaaatatataaggtgctaatctttaaagccctaggaagaaaacagataagaacattttgctctttaaagctggctgctgtaagagatcatgttgatatctgacagatggtagggaaaaaatgaataaaccagtcagcaattctcaaattctgctccctttcaacactagtattccatgagttgggtagaattttattttatttcattttatcttgtgtgtatatatttttgtttttaccgttagtacttaagagaattgttcttttttgaagtcaccaaaataattgtttaatacatagaaatttctcaaatttaagtttttttaaaagggattttgctgagttcatggcatttctatgacttttccctgttcaaatgttatgtttgaaaccagaatatttctgaataaatgattggtttcaccatttataataatgtggtagttaatctattaataaaaatgagagtgacaatttaataagtttttggaggcagaccctgtgccaggtgttctacattaattatgtgtgttatctcactcaatcctcatggcaactctgtgagagcaagaccattcaggaaaacaggctgaaatggggccagcaaatggctcaaaggcacgtacctaataaatggcagacccaggattggaagctattactatatatatttttaaatacctaatttaataaactaaatctattgatttaatttaattatatggcatgtaatagtcatgttttcttctagtaaaattgtttctactggtggcattaagcattttgttaaatgatggttttctataaagaaatccttagaaacctgccccaaatcgtaaataataacaacaaataaatgaagcaaggagagtatgactgttaaaacttatagttcatggagcatttgtcattatcctcaataattgcatatggcatcctgccaaactcaacagtagaatcactgaaagcgagtagctgtcttaattgtttacagaaacagtaaaccccaatcaaaatcatgacagaacattcctattgtgagtatgtgcatcttaacagttgtcctttggtacaatttttcaacaagtaccacctgttactttggtgcttagaattaaaataggtgtaattataactgttactgccccaaatctgtgccagcccctgacatgatcctcacaggacagtccttggcaattctgttccaagcctgagtttcagagctacgttcacattcctacttatctcaggagacagaatcaaattctccacccaactctgaccatagtaattgtttatgtaacatgtttattaaagtgtaacacacaaacagaaaagtgcacaaatcattaagcgtatagatcgatgaattcttacagtgagcaaaccattgtaactaacacccagatagagaaacagaatggtagtagcacccagaagcttcccactacccttcatttccttccagtcactactcctcattcacccaagggtaactattatcctggcttctaacatcacagattcattttgcctatttttgaactttatattaatgggatcattcagcatgcgctcttttgtgtctgacttcgttcgcttaacattatgagatgtatcgatgtagctgtgtgtagttgtagatcattcatgcctcatccactctttgtgtgtgcctgcctggcaaaccagacaattctcctatgagtctaccaatgataatattcttttatagcaaatgaattgagctgatagacagatacatttattaatctcagtaaatgcagtagctgataaaagatgcaaaaggcattctaagagatggttcttttcattatttaacattggtatttcactttcaaggtgaaatagaaactggtgttttaacggctgtttcaaaatcatcgtctgtacaaagatgccaatgtaaaaattgtgatactattgtgcaattataaaagccaagcacagagaggttaataactgccttagttctaccagcaaaggtactcggatcccttatatttccaaggaatgaattctatttatactctttttaccaaagcaggcagggatctatggggaagtaaaagagcaaaataagatttacttttattttcccaaacagaaattaagaaattagcagaagaggccgggcacggtggctcatgcctgtaatcccagcactttgggagtccgaggcaggtggatcacgaggtcaggatgtcgagaccatcctggctaacacagtgaaaccccatctctactaaaaatacaaaaaattagccagacgtggtggcgggcgcctgtagtcccagccaatcgggaggctgaggcaggagaatggcgtgaacccgggaggcggagcttgcagtgagccgagaacgcgccactgcttccagcctgggctacagagcaagactccatctcaaaaaaaagaaaaaaagataaaaagaagaagaaattaacagaagaaacgctatgttcaaaaatagctgatgtgaaagcataaacaaatgaaacaggtaaaagcaggcttctctggataaagggtggagaaagagtggaagcccatctctctgtcctcttctccttggcaatggcagcttctagtggctgctcaaaacctctgatgcccctcataagcacgtattaccatccagacctggtaaaccggcaaattcttgacttgtgcttttgggctgggatctgaggcttctttttgatctgtgacaaaaattgcaaaggcaatttcttctcagaggtagtatttcctccccatttaatctttttcatgaactgctgaagtctttggctcctgcctgtacacactttctgttactcttcttcctacccctatttcataagtccaagcaccgtatcgatcttctgtatagcacaaacagggaagtagaaggacagcagattaatcctgagttgctatagcaaaatgacttatcatcaaagaaagagtgtgacttggaatagacctaccaggaggtccgaaactttgtttgaagtcttcatccatagtcctcaaccctcaatggtactcatacttgtactaggcacttagtaggtgcacaataaataattttttgacgaatgtgcggtatttatgtgtatttaggtgacgttgcatgtttataaagaaattaagtactcaagagtgattagtgattataatcaccactaaacttcattacgttgcttcatagataatagaaatttctcttctttctgttagcaaaatgagaggctgttcacaaatgagaagaatgggtcctttcttcagagtcaaattcctcctttattcattcaatgagaattcattaagcacttactatttgccaggttttattctaggtgctcgggagtgatacctcagtagacaaaacagatgaaaatccatgccttcatggggcttacattctagtgggtacacagacaataaacaacagacataataaataagtggatgatacagtatgttggaagatgataagtactctcagcaaggagaagaatgtgtctggaactgagggaaaaacaagtgcaccaatattgggactttggctttttggggaatcgttggatgatcttgaacaaaggagggacatgatctacttgcattttaaaaggatccctctgactgagaataaactgtggaatagactgtggggagcccagggtgaaagcaaggtagaagtagtgaagcctgtcaatagatagctatcaattatagaagctggggttgtggtggcagcagtggagagggtaagagtaacagatcctaggtatgttttgaagagagagacaacaagattactgatgtattgggtaagagagagatgtcaaggatgactttaagatttctgcctgagcaaatgtgaaggctggtgatggaacaaatggaaaggggaaggttgggaattcggtcttagatatattgagtttgaagtgtctattagacatataagcaaagatgttaaaaaaaagcagttgcacatgagtctggaatttgggagtgaaatctggcctagagatatttgagtgtcaccagcatatagatgatatttaaggccatgggactggatacaattataaagagagtaagtgtagattgaaggatgagaggagaaccaagggctagtcctggggcacaccaacattcagaagtcaagaaaaatagaaggaaccaacaatggtgactgagaaggagcaactaccaaggtagatgcaaaggcaaacaggtgtgatgtcctagacactgtgtgaagaaagcttatcaagtagaaaatgaagatcaactttgttgaatactgctaagtgaaggaagagggctcagaaatggccactagatggagtaacgtgaaggtcactgataactttggtgagaggagttttggtgcagcagtggtaggggacaaagccttataggtttgatggaaatgagaagagaggaactagaaaaagaaagaagaacaaagagctttgctgcaaaggggagcaaacaattaaaggaatacttgtcagggaaattaggacaaagagaaatctgtatctgtttttaaataatgtgtgaaaaatgagaacaacccattcaagatgttggtgacataagggagaaagggaggaattgctagagcaatgtctttgagtaggcaaggggagtggcttctagtgcacgagtgaaggcattacatggggcatggaaaattcatctatgcttaatagaaaggaaagcagagtatatgagtacagatgctgactagtcgggaaatggagtagagtctggaagttctcctcttattcctgtaattttttcagtgaggtagaaagcaaggtgaacagttgagaagctcacttcacctctaaagacatgcatccactgataatgaagggatggcaaaagatattccatgcaaatggaaactacaaaagagcaggagtagctatacttatatcaggtaaaatagatttcaagacaaaaactggataaaaagacaaggccattatgtaatgataaaggggccaattcagcaagagaatataacaacaataaatatatatgaacccaatgctagagcacccagatatataaagcaagtattactagagctaaaaagttaaatagaacctaatgcaataatagctgaggacttcaacgctccaccttcagcattggacaaataatccagactgaaaatcaacaaagaaacattagacttaatctgcactgtagaccaagtggacataatagatatttacagaacatttcacccaacaggtgcagagtacacattcttttccttagcacatggaacattatcaaggatacaaaacaagtaccccaaatttaaaaatacttatattaaatatattttctgaccacaatggaataaaactagaaatcaataacaagaagaattttggaaaaaatataaacgcgtggaaatttaaaaatgtgctcctgaatgaccattaagtcactgacaaaattaagaagaaaatttaaatagttcttgaaacaaatgaaaatggaagcacagcatattaaaacttgtgggatacagcaaaagcagtactaagagggacatgtacatcaataaatgcctacatcaaaaaaatagaaaaacttcaaataacctaatgatgcatcttaaagaactggaaaagcaagagcaaaccaaacccaaaatttgtagaagaaaagaaataatacagatcaaaacagaaatatacaaaacagagactaaaaaaaataaaagatcaatgaaataaaaagttggttttttgaaaagatacactttcaaaacataggaagaagccaaccattttctcaacacgttagctgctaccaccttgttccagcctatcaactctcacccagattttcgcaacagtctcctgacttgtctccctgcttttgccctgctacagatgtccaattaaaatgtaagtcaaatcatgtccctcctctgctccaagccttaaaaggcttcccattttatccagacaaaagtcaaagttgttgccttctccccagcttccttctgcagcctcacctctgcaccgtccacactaccttcttgttgtctctctctctctctttcttttttttagacgaagtctcactctctcgccctggctgcagtgcagtggtgcagcttggctcactgcaaccttcacctcccgagttcaagtgatcctcctgcctcagcctcccgagtagctgggattacaggcgcccgccaccatgccaggctaatttttgtatttttagtagagatgggtttccccatgttggccagactggtcacaaactcctgacctcaggtgatccgcccaccttggcctcccaaagtgctaggattacaggcgtgagccaccgcacccggcctcttgttgtctcttgaacccaccaatcatgaccttcacacaggaactttgcacatgctcttcccactatctcgtatgttttctatggttcacctatccatcttcctcaggtctttactcaaaagtcccacaatcattgtggcttccttgaccatactacttaaaattgcaacttgggtcctgtaaatttcctattctccttccctgctctgtatttcttatagcacttatcagtatctaacatacaatatatttaatttactcattcagtttgtactctgtctctccccatttgaaagacaaaaactggaaaaaaaagacaaggccattatgtaatgataaaggggccaattcagcaagagaatataacaacaataaatatatatgaacccaatgctagagcaaccagatatataaagcaagtattattagagctaataagtagtcaaagacttgtatcttgtttacaatgctttcttcagtgcctagaacagcaccaggcacatattttcagaatgaatgaatttcagaatcatacagtgaggccaggacttgttgtgttgtgtagttactccacagacatgagatgtgccatccacctaaaatttggtttggttgctgacagtgagaatatctcacatgcaccaggaagatatgaaaaagtttattactcacatcatgtggctttctggggatagtaggtctggtttccaagcaggtctgaaagtagccccagagagcagagaaacgatatggagttctagtgtgatttggcgatggggctgggatgaggattcccatgcgcaaggtagggcttgtgcagtttgaacctcctgctagtgccaaaggagtgagcacctgaactttcttatcagctttcccagatgtagggctgaagggtcaggcagggagaggtggacagtcaaacatcagaaatggggtcagaatgttcattacaggtcccatagcaagtaggactgtttgggcatttcatattctttgatcctacctggcacctagcacataagatttgcaagggatcttacaactctaggcaaactgtcttctttttcagatgaagaagactgagtccagtcccactatgtcattctgtctctgtagatcacactttgagctgactcaatagctggcttccctatggcaaggcctagggctgtggagacttaaaaacaatcttgcgcaattttttagactctgactctcagaacccttttctataaaattcttgtaatatctactgtacactttgtcagactaagggattcaatgaaagaatgttaataatgtgccatcatatgattatgctctgtgaagagtcattgctagggtcagaacatggtggtctctagttaaagaccatttggtctaggcatatttaagagaacacttttgagtataaaataggtagactataattatttaattttatatacagtaacagaaatgaggaccattgctttgtgtgggtttgatttttaatatttttttttctttttggagatggagtcttgctctgtcacccagggtggagtgcagtggcgcgatctcactgcaagctctgcctcccaggttcatgccatcctcctgcctcagcctcccgagtagctgggactacaggcgcccaccaccacgcctggctaattttttgtatttttagtagagatgggatttcaccatgttagccaggatggtctcgatttcctgacctcgtgatccacctgcctctgatttttactttttatagtgaaactttcaaataaacagaaaagtaaaaagattagcataatgagcataccaataccctttacatcagtctaacaattgttaatatgttgccttcttcgtctacttgttttggttgttgaactaaagtaaattaaagttacaatgatattttaccccaaaatacatcagtttgtatccccaaaaaataaggatattgtcctatatggctatgatgtcatgatcacactgaacaaaaataatgattccttaatatcatttaatatcagtccatattcaaactgtgttaaggcttcagtaggatgtttcatgagattttgagtcaaattctcctttgtggatctgaaactcctcattccccaattcaccgtgcaattaatgatttcttccctgtttatgggaaacagatgggattagcaaattgtgactgttgcttatttcccaaaagataaatcaggcacatcataataaggaggggaaaagtaatgtttgtaaaattccttggacaaatctctatcttgcaattatgtgtatttgcctttatgtattggagaaattctgagcattaaaccagtctcaaatgagacagtaaagttctgattggatgtcaccatctcccataattttccccagaatgtgtgatgaaagggctccagcctgggtgacagggaagactgtgtcaaaaaataaataaataaaaatgaaaggcttgaaaataaaagaaagtaagcattgagatagtggtttcaagtcactaagagtaaaaaaagtaaaagggccactttactgttttccttatcttccaatcaagacagcgtcatatattttattttattttttatttttttcagacagagtcttgctctgttgctcaggctggagtgcagtggcatgatctcggctcactacaacccctgcctcccagattcaagcgattctcctgcctcagcctcccgactagctgggattacaggcgcctgccaccacgtccggctaatttttgtatttttagtagagacagggttttgccatgttggccaggctggtcttgaacttctgacctcaggagatccacctgcctcagcctcccaaagtgctgggattataggtatgagccactgcacacagccagctttatatattttagagaaccaaaaccaggcatagccccaaagagggaatgatgcctcgttattgccaggtcttgaataagagggtggagaaatgggcacacatgtgaaggagagttaattacttgagcacaaaattttatctacttccctcaattcctcattttgctttgcatgggaattctgtatcagagaagttggagagctttaaagattttgacttttcagttgagatgatgccaattctttgtaattttgttttccactttagttgttttttcaaaatgatttttttcttttttttttattgtaggctttgcacttctgggaggacatccttgttttcttaccacacaagatattcatttgggtgtgaatgaaagtctcacggacacggcccggtttgtaaatattttcttctctccaaagctgatttcagaatctgatggataaatttcaaaaataaaacataattctctttaaataatggttttccctctaattgttctgttctccattttccctctttccctgatattctgaatacctctccctcatcctgtggccactttccatcggttgaaataatttttcttggcaattttttgaagaagcttctgatcataaaatttcaaacttatggaaattttgagttcatcaagtatgactcttagatttaacagttgaggaggaaatgaaggtccagggaaactgacattcagtggctcataactagttactatcagactaggtaataatattaataactactaataacacttattgagcatttattgtgtgctaggtatttttctgacttgtttaatccttataacaacccagattgtcataaagaagtgaaacaacttaattaggcacagactagctgctataacacaaaatctcaaatgtcaatatgctaacatagtgcagatgttcctgattggtaaaagggaagaacaggttattaatttatgtgggttattcagggacactggctgagagtgattctaccatcttcaacatgtgacctccaaggtcagtttgggtgttaacatccagccaggaccaaggagaatagagcatggagaaggcatacttgtttcaaagccaccttagcagggaagcagtacaaacaattccacttatatttcattaggaagtactagtagctcactcccatctagatgaagggagagacggggaaaggctcttccccactatattataatgaaactgaagcataggcctcctgactcctcatgcaatgctcataccactacatcatgtctggctaaaaaatccagagcaaatgtctttgttaaaagttttgccctcaaaagagaagactaatgattcttttcctgaaaatgatacgccatgaagttatttcttgcagataacgtctgctttttatggcaaccaccctagtataaagaattcacctcatttgacttgctgaagagatttcaaataactcttctttaaaccttttagttatgttatttcagatgggacaatgaaagtattaagaagtgtgattagcttctggattctagggacaaaaggaatcaaggaacataaattttttcttccaaataatctgcctctgacttggattatatttgtctgataattctgcttccacaaaagtgaaaatatactttattcaaaagcaaatattacaagctgatcaagggatgaagccagagacatacccaagcaaagtttcagtgaggatcctctatataggaccaggtgaaagatggtgaatgagtcatatgtaaagcactggttggaagagggttcagtgggaggaacagctgagcatccaaaaaaggagttgagcagtgcaggttggcagtcagaaagaggtcaggatccagaaatcagtgcagtgggcaggatcccaagatcaagagacaaacagccaagcatgggctgaaaattgaggatgggtataaacgtgctcttttctgggcttgctctccacacaattctcactgcaagtccttagttagaggagctctacatagatgctgagcaaaacagtctgcttacagttttttttttttgttacaagttccaaaatgattgggacattttgagtccatataattattatagttccattgctacatgaatacatgggtccatgaaatggagtccatataattcattttgaccattttgtcttatccaaaacactgaaaataatagctactccttaaagattgtctgccgtggacctcttgtgctattatctctaaatcttttttaaaatcttgcaaagtaagtattattggcctggttttatagatgaggaaagcatggctcagagaagttaatggagcttagaagctgactaagtcagggtttaaatcaagctgtctttattttctaaggccgtgttgttttgattaccccataatgctgcttctattcagcccacgagaggggcagcgaaacaagttatagaaaatattgggctgggcgtggtggctcatgcctataatcccagcactttgggaggccgaggcgggtggatcacctgagtttgggagtttgagaccagcctgaccaacatggagaaaccccgtctctactaaaaatacaaaaattagccgggcgtggtggcgcatgcctgtaatcccagctactcaggaggctgaggcaggagagttgcttaaactcgggaggcggaggttgcagtgagccgagatagcgccattgcactccagcctgggcaagaagagcaaaactccatctcaaaagaaaagaaaagacaaaaaaaaaaaaaagaaaagaaaacattgacaacattgacttgcacgtcaagaggtccccaggacaacccagaggtttgatgattcactaggagggctcacaggactgagcatatagtcatactcatagttatgatttattacaatgaaagtataccaagcacaatcaatgaagggaaaaggcagaagcaggaaaatgaaaggagtttctgctttgtggagaaaatgacagattaggcactgaacatattgcattaaagtttgaacctctgagtgcaaatgttcacaagtcattggagataaagaccttgagtgaagttgagagctgaagaaatataaatataagctcggtggtaaaaattacctccatggtctcaatgtgggagaattgcagaaggctgtgccatgagaacaggtgcaattaaggagggggaggaggaaatcctcagggcacaaagagaacaagcatagtacaatatcagaagaggctggcatgggagatgggggatgtcagaaaaaggagtagagtagctattgtagaaatctgactttcttttgtgtacgtcattactgcttaatctgccaaaatatctgacaaacaagatatgctgggactcagaaattcaataaagctaaattgaagaagacaagataaatctaccaccttccacagatgcaattgaataggagatgtaaggaagcaaatcttaatgacatctaccttgctgatatgcaccttgtaaccctcagcaatcgcttcctttgctttttgtagaagtttaacattttaaggtgcaaagggattggaggatgattaaatgacattgctggccctttcaaatcaaaagaatcatgcatgcctgacactgattgacggtgttgcttcttcattgctggtccagctgctttgggggcctggtcgaataaaaagtgcctgcacattgttgaaagaagagcctgagggagaatatagtgagtgtagcaaccaaaagaaaaaaaaagaaagaaagaaaaccgggccagtctcttgaaagctgttaaatgcaatttccatagtgccacttatttgttcaaatgatttaattgttcatttattcagaaatagttattgaatgcctcatttttcttccagacattgttttagcactgagaataaaatgctgatcaaggctgggtgcggtggctcacgtctgtaatcctagcactttgggaagccgaggggctgggggaatgggggtgggtcacctgaggtcaggaccagcctggccaacatggcgaaaccccatctctactaaaaatacaaaaattagctgggtgtggtggcgggcacctgtaatcccagctactcaggaggttgaggcaggagaatcacttgaacccgggaggtggaggtggcagtgagctgagattgtgccactgcactccagcctgggcgacagagcgggactctgtctcaaataaataaataaaataaaatgctgatcaagtcaaacaagtttcttgttagagtggaaattgcattctggagcgaggaggcttttgctaaacaaatgaacaaagcatgaatagaagagcaggttgaaataagtgctatgatgaagctaaagccgggttatttgttggtggggtggcggctgccttagattgggtggtcagggaaggcctctctgaggaggtgaaagttaagagctcaataaaatgacagagccaggtacgcaatgctgtaggaagagtgtcacagaaagaactgctgatgcataagcctaaggcagcaacaagctggatgtgttcaggaacagaagggaagccattaatgttctaaaatcttcaaacaaatacattttgaacctgatttttttttaaaaaagcaccttacagattggtcctcagtctcacccaccaaagaaaggaaagataaaatcagaacaaggaataaaaatcctaaatacacattcaaaatccaatgtattgtacagcagatctttagaacttatttatggccgggtgtgttggctcacgcctgtaatcccagcactttgagaggccgaggcagacagatcacctgaggtcaggagtttgagaccagcctggccaacatggtgaaaccccatctctactaaaaataaaataaaaaaaattccgcacacctgtagtcccagctactagggaggctgaggcaggagaattgcttgagcccaggaggcagaggttgcagtgagcccagatcctgccactgcactccagcctgggcaacagagcaaggctctgttaaaaaaaaaggccgatgcagtggctcatgcctgtaatcccagcaccttgggaggccaaggtgggcagatcgcgaggtcaggagtttgagaccagcctgaccaacatggtgaaatcccgtctctactaaaaatacaaaaattagccaggcgtggtggcgtgtgcctgtaatcccagctactcaggaggcagaggcaggagaatcgcttgaacccaggaggtggaggttgtagtgagctgaggtcacagcactgcaccccagcctgggtgacagagtgagactccatctcaaaaaaaaaaaaaaatatatatatatatatgtaacttattcattcatcttctataactgaaataattgttgaacagcaatgctcattgccccccacctccaacccctggcaaccaccattctactttctccttttatgtatttgactattttaatacttcacataggtggactcatgcaatatttgtccttctgtgactgacttatctcacttagcataatgttctccgcgttcgttcgtgatattgcatatgccgggatttccttctttgtaaggctgaatgatatttcattgtgaatatgtaccacattttctttatccattcatctgttgatgaatacttaggttgtttccacttattggctattgtgaatagtgctgcaaggaacacaataatacaaatatctctttgagtttctgatttcaattactttggctaaatacccagaagtgggctaaatcatatgataattctatgttcaatttttcaaggaacttccacactgtttttcatagtggtggcaccattttacatcaccaccaatggtgtggaagaattccaattttccacatccttgtcaacacttgttatcttttgtcattttgataatagtcatcctaacaggtgtgaagtgatattgcactgtggttttaatttgcatttccctaattattagtaatattgagcacattttcatataccttttagccactcgtatgccttttgtgcagaaatatctattcaaatcttttgcctatttttttaattttgacttttatttttttgctgttaaattgtaggcattccttatattttggacattaaccccttgtgagacacaggtgtgcaaatattttctcccattccataggttgccttttcactctgttgattgtttcttttgctatgcagaagctttttagatctcatttgaagtattattacaataaaaaagtcttacatttagagttagtaagattttaaaaattagatcataataaacaagtatcccaaagaagatctgacaattaaggagagaaaaaactgtattgttcttttcttccttgttacaataataaaacctattcactatacagaatattgtggctgaaatctcgttagcttggtctgagttgcattttgtataatctagaggtgactgaaggggagcactgaggtggagctgtccactgatattttggaggagctgatatgttggagtctctaacaccacactcaggtttgatcatttattggaaggactcacagggatcagcatacagtgatactcatggctaagatttatcacaacaaaagaaacaaagcaacatcagccaagaaaaaaggtgcatgaggtaaagtctaggggagactaggcacaagcttccacaagtcccctcccagtggtgtcacacaggatgtgcttaatttccccagcaaaccagttcccaaggcttttactggggactggtacaaaagtgccctctgcctagtgtgatcccaaattccagacacccagaaggaaagcaggtgttcagcataaaacatagtgcatatccaaacagtttgggcacagtggaccacccttctcatttctgggaatggtgggaaccctcctaaagtccaagttcctagatgctagccaagggtcagccttgtaagcagccctttgaaggacagccacctcaaggcgctatgttagcttttttctgcataatcaggctctcatctctcttctgaattttgctcaatttcttttacctagatgtactgtaactggtaagggagtgtatgttatatccatgggaagacagccttaagatttgagttgttttcttgcttcagcatggatccctggaggcctaggttcccctggatagaatcagtcctattgctcacttccctttattgaagagtctctcttaggagctccttctcaccccctaacatatcagaaaacacaaaacatacacatagatattcagttaagtttacttcagatgtgagggtattttcagattttgtcatttaccaggtgctctactggggttatgaactggatattctttttttttttttccttgttctgggcttgtccttttagatgtgacaccagaagtgaccaccttcgcgtgactcagatcactgattttttagaagatttaaatcatatggaatttagcaacagcaagtggggcattatcactccagtttcaaggctttctgtttcttctgtaatgacagcttttcatgcctaatgctcagcgtactactgaaaagtgcataatagcttcccagtcatttgtcttctaatatagtacttagtaatgcagcttcaggaaccacgtgtatgaaaggctccatataaaaccaaataatgtaacactgttctactctaatttctttccctatagatgtaatttacttatggtagtgattgctaaaatgtgttcagctaatttgtaaaaccagtagaaaagaaaatgaatgtagaccactatattagtttcctatggccaccacaacaaattaccacaaacatggtggcttagaacaacagaaatttattttcccacagttctggaggctagaagtccaaaatcagtgtgtcaacaggaccacaattccctttccagtggctttcagtcatccttggcattccttggcatcaccccaaactctgcctccatctttgcctgggcttctctgtgtatcttctcctcttcttataagaatatctgtcattgaatttaggacctaccctactccatatgacttcatcttaactaattacatctgcaaatatcctacttctgaaaaagctcacactttgagtttctaggtagacatgaattttggggaaatgccattcaacccactataaccacatatccacatgtccctatgacaccataaaaggggtttccaatcattgctattctcaaataatgaaagttatagagggatttgtggatgaggcccaatcctcaagaggagtgaaccattgtcatattaaaaggaatatttataaaaaaaaaagctggaatactgttattcaggtatttataccaattatgtccagactaaaaatgttaaaggttttacgatttttggtaaaatgttttaaaatattggtacctaatgggaaatatatatctcatgaggtagtaataaattggtacctaatgggaaatatgatacttccatgaatctttacagagaacaccaagaacccagcaggtatgaaaattctatatttttgggaaaaatgattacaaaagacagtctctcacaccatgaacaatgatatattctcttagaggcagtgtaccagagcgtcaaggacaggggcttcaaagcagagtcacagtttggttcaattcagagctctaccacatgctagccctcatggtttgggccagatgcttctgagtctcagtttcctcagttgcaaaatggagatacttatacttatcttaatgcattatatgagggtaaatgagatcgtgcttgtaaaggacacacgcacagaagaaattcaagtaatgttggttgaatcaagttatgatctaacccaatctcaagacaagcactgactcaattttggctatctctgtggttttcctaaacaggttacactgacccactgaacttccattagcatattttgaagaagttattctaaatgccattataccccattcatttttctctaaggtcttcaaacttgggatctaacatttaaatcaaaacaacctggccattatagatccttcattaataaattgaatatggcaattttattcaacatctctggcttcttccaacaccagcccatttgacaagaacccatctaggtttgctgagagtattatctatcttatttcctcatcattcttatgttgatataactaaaatcatctgggtagagatgccagagggctagaatattctgtttcccagagggagattcagagagtttatctcataatcaatttacattggggatagagattaagtctgcttaagtctccttttgggacttggctgaatttgacaaaaaataaaatcagaaacatccatttttaagtgattacagggttctcaaggatgtaatatgcacaaccaaaacatccttcctctatctcccagtcagctgttcaactggtaagagttgtcagtgaaagaaactggagtttagagggcatgcagtctgattcaaacaaggcaggatggagacaaaagagaaaatggataacaggaccctatgagaatacaacctctgtttgcctttggcttttgagacacttgcaccatgttccaatactttaggaacaactgaactccttttaagagcaccaggattgctgtatgattgtccatctcatcaacatccatgtttgctcatcaacatccatgtttgatctggcccagcacactacttgttttttattttttagtgtttgttcacccaaccacactaactctgcaccaggttttcctggggtcatgagaggctttgtttattgtctttttttgtttcattttgctttgttttgtttcagccttcagggtgttttcattaattcctaaataagtttcaaacttataccaaaagaaaaaacaccaagcaacaacagaaactaagggttggaaaggatttatttatagcaaccatccttttcatggagagagtgaccatcactctctcaaaatggtcattgagccctgcataaatcatcccatcattctcagcaaactattgcaaggacaaaaaaccaaacaccgcatgttctcattcataggtgggaattgaacaatgagaacacatggacacaggaaggggaacatcacacaccagagcctgttgtggggtgggggaaggggggagggatagtattaggagatatacctaatgttaaatgacgagttgatgggtgcagcacaccaacatggcacatgtatacatatgtaactaacctgcatgttgtgcacatgtaccctaaaacttaaactataaaaaaagtacccagtactaaggcactctttatatactcagctattttgtctgatatctatgtagtctgactgttctcatcaaaagtttatacaatctgactgagaattatctttgaaattgagttagaattggtcttgctatgattcttctcattgttctcccattttattagtatctttataaactcattggatgctaatacatttgaaggtttcaatttattataattattattcttattaattatcaaattgtcccatatttggtcaatgtcatctttgttcaagttgggtcattttgacctaactccatcagtcttcgataactctcttgctttgtggtgtgacaagatgttccaggctcatcttgtacatttctttattaagaccaagaattagccattgctctaagaagacttggggcattttcaattactttcaaagtcacacttgggagaaatttcctttcttgaatgatattttgtctgattattaaaataatattccttttgatagaatatactaaagaagattaaaaaaatagagccactgataccaccatcatccagaaataatggatgttaacattttatctctggaaccatctttccacttaaagtttcatgccgtgcctttcctttttctaaacagtaggaaaagagatgatgaatgaaactagacattttaaatatttagacaaaataggttgaacacatgttttaacttgttaatcatttttgaaaaatcctaatattggccattaaacttccagggcaagctggtatatgtgggaaactttaaatttgagtaatttggattttgcaaaagtctttttgctaccattgttggctaatgccaaagattgtctgcagagctgtaagaatgcactggaaggcaaacagtactgtatatattaatagaaatgaaaagagggtaaaatgaaaagtcattatagaaccagagagtatttttttaacttatcaacttttcatgtgtagcatgtataataaagctcttacaatgtttaaagctggggttttagattgatggagagctctataaatcccagattactattaatgtgcttgtagtccagctctagttacagggttgtcattgtttccagtgaaaaggtttgtttttattttttaaagatctttagtagcctggaagaattaaaatggtgatttctagcaattttaagcatgaagtagataccaatgtcattcacaaaataatatgaactaattgtctagttaagtgtctttaatatctttgttcccctaagtgagtccaacatgaaagcaacctaggagctgctccctctccacccccatatcattggattccaccttactcgaagctcctgtggctgaaagaggactaaagtggcattttctgccaggctttgtcacgctcccttttgcccacaggtgctttaacctccaaggggctttttgtgcctacagggatattccgcactctttgtcctttgtttacagtccaatttcataaccttatgaatttgtcaaacatttagcattttttaaacctaaaataataaacgttcctcaaagcacagctaccaagtcaacggcgtaaatagcccttgggagcttttcagaaatgcaaattctcaggcctcaacccagacctcctgaatcagaagcagctggctgtattttaccaagtcctcctggtaattctgatgcatattcaaattttcattgctttaaatattcacacactacttatacaaccaataaatcaaatgtatattaagtgaacaaaacgaatctactcaaccatttacacattgattgcaaacttaatgaaatgcttttaaacatttaacttaatcacaagcctaacatttcagatttccctgcattaaacatcttacaaaggaaaaaatacacgtaaaataccacgttgtttacatagccgattattattttgacaacaaaactgggcacaaagctattaatatcatagatttaattttgtttttttattcttaaatctccttttatttttacttttgtatggtcctggaatttaaacttctgtacattgctggattgttgggaattctacaagagactctttatactttctcagggtttatgtaatttttccagactggaaagaacaaacatatcacctcgggaagtcagggatacaggttaagtggattactggccacttaattttggttggttagtgggaacgggttgctaaattcaaggtgacttaaactcaagttgctggccactagacaataattttttatcacatagtttttgttttttgtcatggaatctatattgttttctcattgctgctttaacaaattaccacatacttagtggcttaaaacaatacaaatatattatcttacagttctggagggcagaagtctaacatgagtgtacagggctgtgttccttctggaggctccagaggagaatccaattccttgtccattccagctttcaagggctgcctgtatccttgggcttgaggccccctttttccatcttcaaacctagtgtcttcatagcttctcctctcatttctaacctcctgcctctctcttattctctagtgttatattgggcccacccagggtaatctccccatctcaagatcactaacttatgaatatgaatcttcaaaattccttttgtcaagtaaagcaatacattcattggttctgtgggttaggacatggacatctttggggaccattattttgtctaccacatgacactttttgtcaatgtatttcacatttttactgtgcatacacatatacacaatgtattttttaattaggctttacaatatataattttattgcccggtttacaactaaatatattgtgaacattttcttttcttttataacagttaaaataattgcatagtttggagaaaacataatttactaagcaatcttgttggggaaatttaggtataatttttttccaaggagatttcattcttttacaatgctgttagaaaaaaggagagtctgtcttatataactttctatagatgatggaaacttgcccttcaatttagccttttaacttgcttctctacatccacctaatcatcagtcaagtaattcattttcttttttcgtgtccatctctcccatttgcttcctcttttttaccccatctccctggcacacatgcagacagatttctattactaccccagcgctttctgatccttccctccatggcctccctttaatgaggctttctttcattttaaagagaccattttaattgattttgatcaactctactcaaaactttatcctcagtttcgcattaggattagcctttaataatctgaagatataattcaattgtttaaaagaccgtgttaataagaccttggtagagttacatgtatcaagaaacataggacttgggcacaatgtacatacggctgactttcttttgaaaaaggaaagtagtttctgggggggggcagggcagaggtaagaagtaattggtacgtgaaggaagtgaggaagtgttagggaccattatggaaatgtattctttttttgttttttgagacgaaatctcactctgtcacccaggctagagtgtagtggcatggtcttggctcactgcaatctccacctccctggttcaagtgattctcctgcctcggcctcctgagtagctgagactacagtcgcatgccaccacaaccggctaatttttgtatttttagtagagacggggtttcactatgttggccaggctggtctcgaactcctgaccttgtgatctgcctgcctcagactcccaaaactgtattcattattttaaggcaactaacaaatgatcttctttcagttaggacattggagcagcagactttactggtcatgaaatttgcatgatatctaaagttgttatttctggaaataggtaaatgtcagttcatagtaactttgtatggaaaggcatgtgccagctagcataaaagtggtacatgcagatggtagttttccagagtcctgggagccatgaggtgctcaaacatcacaaggccatcacaaccaggtagaaatgcctcaggaaagcagaggggttggccatgccagcatttacacataaaacgcttcttgggcagccagatgacatggtgcacagacccacagttctctctgcacacaacatgctcacagttccatccataggaggaagggaagacacaaaagcaccccagcgtgcaggttcccccatttggacagcaggttctgttttgttccttactgtcctgtgtccccatggatggcacaaactctgaaataaggatgaattgcaggctcctcctggggctgagtgctgtcccctctgaaagccaagtcttcctgagatagacatgcaagttatggtggcccaacccaacctggccaactaattctagttcaaatgcttttgaaatggccatgatcaaaattacactccgtcattgtcccctgaacgtttaggcaggccagaggatgagagagagcagccgtatttttatcttttaaattgattctgtttttttttttttgagatggagttttgctcttgttgcccaagctggagtgcaatgcagcctctgcctcccggattcaagtgattctcctgcctcagcctcctgagtagctgggattataggcacatgccaccacgcccggctaattttttttttttttgtatttttagtagaaatggggtttcaccatgttagccaagctggtctcgaactcctgacctcaggtgatccgcctgcctcagcttcccaaagtgctgggattacaggcatgagccactgcaccctgccatggattctgatttttaaagaaatttagaagatttaagttttgtttgtttttaatctctggcagcacatgactcattgcaatatttaataatatattaacctggcctggtttcaatatttaaaaacattcatctttcttattggcattgtgttgtaattaattagttaaatcatcaaaagttttcatttccagagaaacagaaaagtgaatcttaaaatttagacttcttagccaagtgcggtggctcacgcctgtaatcccagcactttgagagtctgagacgggtgatcacctgaggtcaggagtttgaaaccagccaggccaacatggtgaaacctcgtctttactaataacacaaaaattagccgggcgtagtggcgcatgcctctaatccaagctacttggtagactgaggccggataattgcttgaacctgggagggagaggttgcagtgagccgagatcatgccactgcactccagcctgggcgacagagcgagactccgtctgaaaaaaaaaaaatttagactactttttatggacatttaactaagttagtattttggagtaaatggttattatcgttttcctcattggaaattgcatatgcgactggtgctagccaaccgctggactccttttctagttcacttatatatgagaccacaaatgctgctgaggcctgtttattcatggtacagtttctactatttctaggactgtttggcttacaaattatgttagtaatttgtggcttatgcagataaaaacaatacatatctatactatatgaacagaaatatacttaacaaaaacccacaaatatctatctatagttatatataaacactttcctacttatgtaagtaaataaatttacatgtacataatattcactcttctttgatattactattataattttgtacattttatttacattaacttttttcttatgtacatcatgtccctttagaagcataatttatttcatttcatgatctttattactacaaatgatcacaacttgaaaaatgggagctcctttaagctgactgtttttctttcagcagtgcctctgccatttaaaaaacaaatcactcttgtttcctggcaagaacaaaatgttacagacctattctgattttattctgcccaataacgtgaaactgactatcctctaatggtttctggttctttttttaaaaatagaacaatattagagacaaaaatctggtcactagggatgtttacaagtgtcaagtggggaaagactacagctactgctgctgccttgggacttctcttgctagcgactgagcttaaagaaaatacgtcttttataagtgtgtaaaatcttgttctttccagtatagcttatcatatcgttatcccttacttttcttattgtatgagatttcagcaattactaagagtttcttcctctacattgatccactgtgtcacccagtggcacagtagcccactttcctcccacctcctctctcactccgttttctaggacaatggttctcagcctagtcttcatactggattagcttggggagctttaaaaatgttgatatgggtctcactatcatagcttctgatttaaccttccaaaaagcagaatatggcatcaggattttgtaaaagctccataggtgatactaatgtgcagccaaagtaaagaacctctgttctagaaaagtgttgcaacctgaataaagccaaccaggcatactcccatgaaattacaccacagaggttccagggataccagcttgacattataaacagaaaaattaaatgcatgcttatcttttgactgctttgcttcaggagttttggggatggggacttgctaaagagagaaaaacacacctgcctttttttcagtcttcttgaaagactcatgtgtacaggtcgttgacttctccaattgttctgctagcatttctgtctttcagtctcatcttcctcactccttcctaaccttgctctaattacttcaaggttttaaaaggccttgatttcttcatctttgaggttaagataatgtctgcatgtgacacacactaaatctagcaaaattcaacaacatactgtaaagttcgagaaaaccataacaggttggcagcctaaggtcctagctgcctaaaatgatttgagaggctataatagaagtcaaatctgcttttctggctatgagattccagaaggtcaactgcagtgttaatccagactttttttatttgtctgtacacactttagggagtgctacatgtttaaagaagtctgaagtatgacctctaggattaaacacccctctgcccccaccctctccttctctctctctctttcttggggttttagacatcataaaattaaccaattcatctgatatagggaattgatagttgattataattatataccttattgacatatctacctccacttaagttacttttccatgacagaagcttgcattcttatagtatgaaaaacagaatgtctgttttagtaagaggacaaaggcctaggacctactctatttctgtgtaatctattagtattagttcttcacttagttccgatacacacccaagtctgggaaccattgtcttagggcatcaaataagtaagggtagttgcttctctaacgagaagggccttaacagaaggtggtgaactattctttgctcagaggagtttagctgcctttttccctcaattccctccctgccaaggatattatagacagagtcttctgtttttgtgggctgccatctcagaagctttgtctagtcttgatatattgcctggttaggattttaagaaaataatagatgatgctttcaaaaatatggcagtctcaattccctctttcttaggagtctcaaactttaatatgcaaatgaatcacctggaaaccttgttaaaatgcagattctgcttcagtaaatctgggtggggcctgaaattctgaagatctaatatgctctcagatgatgctgatgttgctactctgaggggcaaggtgctagctttggttctcaactttggcagcacgttacaatatagtaagaatatttttaaaaataatgatccctaggtcccactcctagagattttgatttttctgatttaattgatagagaatatggcctgggcatcaagagtttaaaaaactctccaagttgccaggtgcggtggctcacgcctgtaatcccagcactttggggggccgaggtgggcggatcacctgaggtcaggagtttgagaccagcctggccaacatgacaaaaccctgtctctactaaaaatacaaaaattagctgggtgtggtggcgagcctgtaatcctagctacttgggaggctaaggtgagagaatcgattgtacctgggaggagggggttgcagtgagttgagatcacgccactgccctccagccagggagacagagcaagactccaactcaaaaaaaacaaacaaacattctccaagtgactttcatgtgcagcaaaatttgaaaaccccttgtcttagtccaccatcaaaagttaaccaatatcacatttttttaaaaatggctcttttattcacttctcatgctataaaatatagcgcgcttagatagttcaaagcagtggtttacaaatctctatccccactgaccctggtgtggagaagcttccatcagaagtggtagaataagaaaaataaggataagaattatatagtaaatttcataaagctcaaataattcatttcaaggattcttctttgaaattgtctttcacacctttttgatgttaaaatatcctttttaaattaaattaaggtagtaacattatacctgtttatttgcttttctcatgctcttaatttggtaaataaagagttgcaaatcttatgttgatctccacatatttttggaaatcttgctggttcatgaaatttgaaaatctgggagccatgggcatgataaatccattaaaaattagaaaaaatctgatctttaagtctagaaaaatattgttataggaatatagtttttaatctttgattctctaatccctggggccaagcagtccttgaattttgtaagcaccagagtttattgctttctgtgtcagttcaggtccactaagcagatttcaagaaggaattagacttgcaagagatttattgagggaaccaccaagaaacataaagagagaggcagcaggagtgggcaagagggccttcagacagggaggcaggtctgacccctgtgggaaagaaggatgcgtgggtagggagagagcctcagccagtagcgcagctctgagaaagtctcagccaggctggtggggagccccagagcacagactgtctatcagagaggtccctgtcacgcaggaatggcccagcgctattctccccactgtgttctgtcatcaggttggaacagcctggggagggtggccttggcaggaatgctgcagggcatccgaaggtgtagcagctagagtgtcagccaatggctctcctcacagcaagttctcttctgtagggcgatctgtgtgtgcacttccatggctgccacactgggacttgcaattccacagtgaaaatgtatcttttttctgttggatgatgtgaaagaaaattagccatatggcaggtcattaatgtttctccgtatatcttgcttttggtcttgtcccttttaaccaatggccatttattaattataactcatcattatgtctgctgggcccacaattatctccataaaaaatgtaaaatcgctggtcactggataagtcgtgggaggtagaacatctggcttatgtaatgaatacatgtttaatattaccttttaaacctgtaatgttggtaggttttcatgtagtaaaaattctatttattagtatttcttgttattatttctgatcttatattaaataaggcattattaagcataattatcttagattatctttttcttggtttgccacagtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggttggtttatttatttgtcttacaaaagagcaaaatcaaataattcctgacttgctttaagtgaaacagtttacttaaatcatggtattggtgttttattttcaaataccagcttgacaaagaattacagcttgtgtgtgcattttctggggaaaacaggacattgttaaaaacagactctaagatcgctctgcactcaaccctattcccaaacccttttagcccatatctcatcttatgttctgtcaatccctttgatttttcggtgccatatttaacacaatgaatgaatagagaacactggagcatacaaaatggacaagccatatgtgattctatagacatcaggtctgtggcttgggagtgaagactggtggagtgtgctttgaatattcaaaaaggttagttactaagtcactctggaagagggggacactttctatcattttaataaactggttatttaaagtagggttaagaatatgcagaatttatagaattggggctcaaatttagccattctagtcctcccaaattaggaacttgaataactttgaaagattcctcttgtttggtttgccacagccaatctacattatattgcccctggaaatcctaacagccatggtttctatgtctatggataactctgaggagacaagataaactggataggcccatcttcttccacatttgaataaactacacacatttaaatgtgaggttaagctcaaaataaaacactttggacatgaggatgagatccatgcagagaagatgatataattatgtcagataccaaagtggctgtctgtgggtgtggctttacatatacaccagataatttaatgcttccccctggggctttatcattactagattataaattcattgagggaaaatgagctgtcctattcatcataatgtcccctgcaggaccttgtgcaatgccttcatataggagacacttaaagtaggagctgaatgaataaatagcagcttgttaagagcatggaatctaaatcagatggatctggaattaaattctagcttagccaactagtagttctgtgatctccaaattgcttagcctttctcttttttaatctttttaaatatataaaatatatgaaacctacagacacttcaagaaaataaaacaaacattcatgtgttcacacagttttgtcaattcttaacatgatgttgatactttataattctttgctgtttttcaataaaacattaaagatagagttgaagcccaccatgtaactctgcctaatcttattttcttcctttccacaaatatgttattatcctgatgttagtatctttacacatatctatagccataaacaaccaacagtattattattattatttttgttattattattatttgagacagagtctcactctgtcacccagactggagtgcagtggcatgatctcaactcactgcaacctccgcctcccgggttcaagcgattcttgtgcctcagcctccggagtagctgggattacaagtgtgtgccacgcctggctaatttttgtgtttttagtagacatggggtttcatcatgttgaccaggctggtctcgaacttctgacctcaggtgatccgcccaccttggtctcccaaagtgctgggattacaggaatgagccactgcacctggccaactaacagtattattgagcatctttgtcaacttcgtataatgggaacatgctctgagccactatgctacactgttccaggtattctgtatttcccctttctcataccaaagaatttcagctccataaaagcagtgatttttgtctcctttgtttattgtatctccagggccaaggacagtgtctcagtgtctggatgttaatggtgctcatttgtatccaatgagtgaatacaactaagactcagatttgaaatgtatgaaactcttagtctctgttcaagttcatatggtgtcttggtttaagatattaagacattttaccacgtttttgggattgtacattcatattattgagttgctctgtgtaatgcaaaaaaattgggaattcattccttctaacaaggcactaatactgagattaagactatttattttaaccttagtaattgctacacataagcgaatttacgcctggatttcatctccttcatcccgtgccttttaggaacactatagctctctgaaaggtcttaccctcagctggatcggggatgg

SEQ ID NO: 3325 - DNA, 68905 bp, human
ggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtaagtgatggtcagagacttgggtttgatttaggaatcatggtgatgcataaaactatattctgcagtaaggcctctttctgcagaatgtagtgccacgctctgctttactcttatttgagacagctgcctctaattccagcaaagctttcatttctcagtccttctgtaatcagatttcaccgtgtgctgtaggggaagccacccatggcaggtataacagactaaacgttcttgacatctttcgtttgtgtacattctaaacgagcaagtggctgaaggaaattaggggaagtaatttacacagggccttcagcttatatttgggcttgctataaaacaatatatcactctaagatgttgagactaatcagttcttttgaaaaaacagactccaagtagcaactaataaatactgacaaagctgctgcaaagacgccttatatgtgatggggataacgacatttttaaataaaatacaagtttgaaaaccatccctgaaattcttgctggcatgtgcaaagcaggctgtctccaatgaattcattataaaagtttacatcctgcttacaaccattgtgcatgtggttgaagatggcatggagtgtgtctgtggggaagggaaaggggaaggggaagggaacaggggagatgagttagctgggtaaacaaggccatcaggtggagacatcactaccagaaagcttctagaacagtttcatgttaataatgagacagaatttcttcagagcctctttataacctaaagcaaccttcccgacttccttaaggaagaagcttttggtctgaagttttcttttattattagtaagtggacctgtgatagtggccctgggcatcccttctctggagcagctgacagttctaggttctctggactccaccattagcactacttctttagtgaatataaggctctcagaagtcagaatgataccgtaaataatattgtaaattaagcccataatattagacctagttgagacctcagagccatgaaataatgccttctcttattttattttgggaggaaatgtgatttttatttcttaaacagctcaaatattcaattgaaattgtttcacttctcttatttcaagtataaggtaaaaaaagcccagaatgactgtggggtttaccaattagtgccagagttagatcagataacaacctggagaaaagtttaaagaactaggttcaaggcctagcaccacccttgctggctatatgaccttgaacaagtcactaaacttttctgcaatgttgtttcacctataaaatggaaaaaaggataatacctgttctgcctacattacagggtggttcaatcattccttcaacaaatattaattgaacatctactttgtgccatgccctatcaaggagttggagatacggtggtaaataacgtaaaaatatacttcactccagctacatgaattcatagtctagtgataatcagtgagataatgtatatgaaacctaaaaagtgacagaccaatgttcattatttattttagtattccattacactgagttacatcagataaaaatgtgatgaaattttattctatagcttttaacaaggaatcatcactgagttgaaaacacccaactgaatgaataatcaaagcctggaacttaaacttatactgttctttgaaaactacaatgataattgatttttaaaataattattacggattaaattttgcaagtaaaacctcctccaaacagttgaactttttttttttgtatttactaatacactactgtctatatccagtagccagactacatttctgaaaatcctggtgagctatttctcacagtgaatgggggctggcacaaaagtatggctaaatcggcccaaatccaaactttctatttgaaagtgtgaaagcctcgagtcacccatgttgttagaaactcaatagtgtgaatctctattgaaaaatgagataatgttgaaatggtttcgacatgcattctcacgtggcataggtatttttctttcctactgtattggttagttgcactacctgtcagctagataaattcagaatttctggtctccaataagacttacaacctttgacaaagccctcaacaacagagaaaaactccctgtcaactctgcctgttctatatttttgctttgattttcagcctttcacagggattcgagttatttttttctcccacatctcttgggaaaggtggagggcccttgttatgtaacataccacgtgagtttactactccagaataataggaaatatgtggttagaatttgatggtgccacaaaataggaatcgcagttttgaagtgagcggtcatatcgccatggacatgataaaataatagcttaagtgaggctgaagccatccacacagcccctggatcaatcacttttagtcagttaaatttttttttaacaagatcgataggatcagaaaccaagactgctgaaaacacccaattcacaggctttccatgtcataaacaaggctctaaagccttgctgtgtttggataatagagaatatcctatgatttgttgcctattagggaaaccacttaaagctttttaagaaaccactaaaaaaaaaatctctttctttatcagaaaagaccaatttgtaagtgcagttcaatttcatctcacaaatagaaatttcttcagagaatattgagctaagctactcaattctgtggaggttatggattggagccagaggtgactagttttcaggtgtttcattccagacctctgtaagggctcacataactcattatgctcccttcgtctctcacacatgcccatccatacacacgtggacatccagacaacgtgattataagacgttcatgttcttgcatagaggagagaaaccagtgcactttgattattcacaatgtcgaaacttaaaatgaatgccttttaaaaacatcacttcagctgggtgcagtggctcatgcttgtaatccctgcactttgggaggccgaggtgggtggatcacctgaggtcaggagttccagaccagtttggccagcatggcaaaaccctgtccctgttaaaaatacaaaaaaagaaaaagaattagctgggcctggtggcatgcacctgtagtcccagctactcaggaggctgaggcagaagaattgcttgaacctgggaggcggaggttgcagtgagccgagatcgcgccaatgcactccagccacctgggtgacagagcgagactctgtctcaaaaaaaaaaaaaaaaaaaaaaaaatcacttcacttcagaaaaccatacaagagatgggaccaaaagttgaatggggtcatgatgttttccttggccaacagtggaatttgtttcctagtttatttttagtaattgagtaacgtaacttagataaaataagccactgatttttgagtttcaggtttccagatctttaatagtaggtctgcagaaagctagccttcatctgaattcttcaattttcagatgagaagtttcacaattttagaatattaatgatctaaggtatcttagaaactactagtcactcagtgctcaataataatgttgtagaaaaaactgagttcttttcacatgaccaggaaagtttaggctcacagacactttgaagggtgagggggagcggaatttattgagtgaaaaggaaaaaaactcagcaaagccagaggggttcctgttaacaggcccccatctcacagactgaatgccaggttaccacacaggaacaggagaggcctagctcctccccactccaaaaggtgcagtgcgaacttccccaaggccccaccctgtcctcccagtgtgcaggtgggcattattcagaaagaatcagtcaggggagtgtggggaaagggcgggcctcatccgggacaggcagtcctgttcatcagcctacaggctgttttaggcttgaacgtggggtttcgctgggggtcgcgggtttgggggcccttggctgccccttgtctctatcaataatttatatcacatatgggtatgtggcaacagtgaggagggtttcaagtaaacttttattaatacattattattgttattgttaataagcataaatttggaaaacatttgtgagtttttttcacatcagtgggatcactgcaaagtttttttttgtgaaaatacagctcctttcttttgcatgcattctaatatgcctttttgagaaggaaagaaagggatagaattaaagttaggccactgaaaattcatgtggctccagtttacaaacttcatgagtgtgggggaagacatagacaaagagaatcgctaatttcgttcactttattaaattttcaggtgaagaattgaggctcgagatggcaaataaccttcccaaggccattgtttattcttaaatctgggctgaactaggactacaattcaaatatttaaaggcactgctcttctcatttcattgcttgtattactttgatcccttccaattgatcaagctggccaatctacctttgcctaatatccttttttaggtacagccagaatatctcagtaaagaaaaaaaacatacacaagaaaatatgccttagctcttgcattaatgcaaggttaaagaaacataaaaatctcagccataaggcccattggccccctcttatgtctccagaagttaaagtctttatctcaaattgtccatggggatcagagtatcatttaacactgaattttttcctactctggcaaaatcagtttctgactgaccacattttactcaaatcaagcactttctcttccaataaaatacaattataccaggaatacatccaagtctctcccaccccccagtttaccagagttggaaaatgcagacactagcaatgaaaggcttcattctgcaagtagcaaatactcttccattttgtagctaggaagatatttgggtaaagttaatacaaggatctcttattaccttggcttagcttcttagcattcagtgatttggggttaagaaatctctgtaattattttttcaaggaataaaatgaatataaggaactagacttgcctttttcaagggctctggctctgaccagactgcagtgacagttttgatggagtatttgtacgtgcttctcattgtttcccacaacattgtatcctccctcttatgtgcagcctgaataataataatgtggtttgtgtctggtgtaccaaggagatttcttgtttactctgatttacttcttgtacactttggtacaagaaaagcaagcattttacaggagactcgaataatgcatttggccctggttctggtgcttgtgaaccagagcaggctgcctcctattgaagaatgaggtctctagggggaacttaatagccattgatgccagcagtcttacctggctaattcaagcgtggctttatcacccaaaagcaagaaaatgcttgctacagaccagaaaaaaaaaaaggaggcctgtgtcagaactgttttaatgtggtacaattgtggaactcttctaatttttatgtagcttaggaaagaggtgtggcaactccattttggagccaaggggaggtctgtgaggagacagtaaacaggataggaatttaaactgggaccattgtatttgctttccttccagtgataaatttccctggttagttctcgatatctatgaaaaacagctctttttcccaagctaacatttcctgccccacctcctggatggaattgagaaaggtggtgactactctaatgatttttcagtggtataaacagcataaccccccctcactagctgtggtggaatttttttttttttttttttgagatgaagtcttgctctgtcacccaggctggagtgcaacggcgcgatctcagctcaccacaacctctgcttccagagttcaagtgattctcctgcctcagcctcccgagtagctgggattacagacgtctgccaccatgcccagctaatttttgcatttttagtagagatgaggtttcaccatgttggtcaggctggtctcaaactcctgacctcaggtgatccagctgcctcagcctcccaaaatgctgggattacaagcatgagccaccgcacccggccagctgtggtgcaattttaaaagaaattctagttaatcactcaagccctcagatgctggtatgaccagatatatagcatctacctctctaccgcttttgtccccaagaaccctgacaacttattctgtccaaaaggagtttgtggcaagaaagaaccaaagtatcagtgtagtccactattactgtacttccatttcagccttcatggtggtatgagcaaacattggccctataaggtatacttgccagttttccaggttttggcccttgactcatagtgctgtgcttaggatccaagattagtccactcttgtttcacatacatatgtccagtcattgttcccagtagtgcaaatactataccagagtggtggggttctaggggatttcagctttagcaacacactaggccacagtcaattatcctccatgattttcaggccttgtgttcagcctgggccataccctatatttgctcttccctcaacataaattttgtcttttttttttttttctgagatggagtttccctcttgttgcccaggctggagtgcaatggcaccatcttggctcactgcaacctctgcctcccaggttcaagtgattctcctgcctcagcctcccgaatagctgggattacaggccctcaccaccatgcccagctaattttttgtatttttagtagagacggggtttcatcatattggtcaggctggtctcgaactcctgacgtcaggtgatctgcccgcctcagcctcccaaagtgctgggattacaggcatgagccaccgcacccggctgaagtgatgttttttaaaaggcattcattttaagttttgacattgtgaataatcaaagtgcactgttttctctcctccgtgcctggcctatgtcttttcttatcatcagaacttggtcaggatgttgaaaatccatcatgacaaatctttcaatattcatcccagaaatctgctgggaattaattctttctttcttttttttttttttgtttttgaggcagagtttcgctcttgtcacccaggctagagtgcaatggtgcgatctcagcttactgcaacctctgcctcccgggtttcagcgattctcctgccccagcctcccaaggagtagctgggattacaggtgcctgccaccacgcccggctaatttttatatttttagtagagacggggtttcaccatgttggccaggctggtctagaactcctgacctcaagtgatccgcccgcctcgtcctcccaaagtgctgggattacaggtgtgagccactatgccgtgcctgaattctttcttatacaaattgatttacttttgccctaatgacctactatcatttattcatttacttaagaaatatttattgaatgactactacattccaagcactgtactaagcaccgggtatatattagtgaataaaataggaaaggtccctgctatttgtggatcatatgtaatccagtgagaagagtaaaagtagcaataaataaacacataaatatatattaaaattgtgataattattacaaacaaaatgaaggtaaagtgaagactacttagacagtagagtcaggaaaggaatctcttaggaagtgatatttaagcttacagcctgagaatgagaaggagccagctttgagagttgaggggagagtgttctggacaaagggaatggtatatccgagtcctgtgatgggaaagcttttggagtacaggcagcccctcctttgcgatatcccaatgtgcacaaatttcaattaccacagtttagttaataacactaggccactacgaacacagttcaaatttcagtcaacatggcatattaattatgagtaattcataaagcaaaacttcattgctaactcttcagtctacaaatcaccatgtaaataacacatacacagtacctcatggtcagtgaccaattacatcacttctttcaaagtctgttggtgattggtcactgtgcatctgtcattcagtttgcatacagacagcaaagagtatatagctgtgctgcctccttttctcccagtgataaacccatgggcattttacaaaaatggataatgacagtgcagtacatgaaagtgcagcagagaaataaaaagtgcctttgggaggctgaggcgggtggatcacctgaggtcaggagttcaagaccagcctggtcaacatggtgaaactccatttctactaaaaaacacaaaaattagccaggcgtggtggcagacgcttgtaatcccagctactcaggaggcttaggcaggagaatcgcttgaacctgggagacagatgttgcagtgagctgagattgcgccgctgcgctccagcctgggcgacagagcgagactccgttaaaaaaaaaaaatactgatagcagtggaagttaaatttggattgaatgtaaatcgagttatggaagaaacagctgactatgtgattgttaccctgctgctgtttgagaggctgtagatatacagccagaggaacttagtgaagacaaagttattgacataactgcagaaagtggttgtgacaaaaaggatgaagatgtcccaggggaagtaacaccagcaaaacacttcacattaaaggaactctcacagatattacacagcgttcaaagtgcaaaggaaaatgttgaaagtttatccaaacttagaaagaattatgacagtttaccaaaacatagaaaagatgcttgctctatatcataggttctaagatgagaaagcaagcactgttcaaattactcttgatagagtttttacaaggaaataaagcactataattctcaatgcttctaatgttttaaattacattgtactaaaaaatacatcagttttactatttttcacttccctacacatttacaactgacaataaaagtttttaatgttctgacaattttttaaaagtcacagaacgattacaattttcccactaaatattaaggttactttacatggcttcagatttaatggctattcacagtcccacacactaccatgcaaattaaaaactgcctgtgtttaaaaaaaaaacagttttggaggacattatgctaagtgacataagccatgaaggacaaatactatatgatttcacttatataagaatcaaaaatagccaaactcatagattctaatttaaaacatcagacaatactggttgtcagaagttgggagtgggggaaaaggggagtttttctatggatctaaactttcgattattctagatgaataaattctagagatctgctgtgcaacatagtgcctatagttaacaatatggtgtcgtgcagttcaaaatttgttaggagactagatctcatgttaagtgatcttactgcaaaaccaaacagcaaacaaaaacacaaaggggcacaaggaaactctggggtgggggaaggttatctgctaacatttattggagatgtgattcaagggcagcaagagtgagggcagcattatcagctgctgccatggaaagtctagagtcagaaagggagatttttccaatcacttgtagtccaagggaaaaatattgaaataaagtttctgttctatatacatttgaaaatcaaaggccttgacaaaaaggaaagcttcaagcaggatgtttgtgtgttctttctacctttatattcaaatcttctgtcagtggagaaatagaaacagcagcatctcacaatgcaaacccacagcagaacattaaccctaaccctaactacaagcttaatttcacttccaacttagaaacttctaagtatgtaggacaaaagctgaggaagccccagaaacttgttactttctccagtctgtcttctattggggataataagaactggaagctggagcttttggagtagtaaaaggtaaggtattgttggtcctcctctttcctgtttccttttatggaaattggggagaaaaaatttagtcctttgcaaaattttcatttccacttctatttctctgagattcaacaagaacaacacaattctaagatctatgacattctcttaaataaagcctgtagccttgtgagcattcagaagtaagaggatacaacaaaatcccgcagaggctgagaataggggatgatattgaatcctttaagtatagcagtttggagactcagcttttgtgggctccaaaataaccaggagtctgagcttgaactcaagacaaaaaattgagggcctcaaaattagttcatgagtggtttttcctgtggttgatggatgtgagttcaacagctatagtgatgtttctcaaattccttgaaacagagggagtggggttttccagcaaagtattcttccccttttaaaataatattagaggaagtcttaagccaaggaatatcaatgtgttattgtaagacatgtagtcaagaaggtttatcttctgtaattttatgttgcttggatcttattccagaagaaaaatattttcaaatctgccccaactgtgaattgagaaagattaagctgccgtgccttcatttcaggccacatatgcaaatctgttttataatccccagaagaagatttcagttgaccctgaaaaatgcatgactgttagtcagtgcttactccttaacattatcagtacttagtattccaagtgttgcttaatattatcactaattaatattatcagaagaaaacacataaccaaaatttgtacgtaaatacaaattttctgtctaaatgccttgcttccaaagttatcaaattgctgactatgatggagatattgggcacagttgtgtaagcattttactaggatttcagtagaaggaagaaaatgaagggctgtctagaaactgctttagccagcaaaatgtctttgtatatctacaaacttatttttaaaatatttggttctttgccgggcgtggtggctcacgtgctgtaattccagcaggttgggaggctgaggtggttggatcacctcaggtcaggagttcaagaccagcctggccaacatggtgaaaccctgtctctaccaaaaatacaaaaattagctgggcgtggtggcacatgcctgtagtcccagctactcgggaggctgaggcaggaaaatgtcctgaaactgggaggcagaggttgcagtgagccgagatcacaccactgcactccagcctgggtgacagagtgaaactccatctgaaaaaataaataaataaataaatataataaaatatttggttcttcttagtctaaaccttttaaatttttattttcgtgtatgttttgttatgtacataatctattagtatagcagcacatataaacaaataaaacatacattatgaatccatgtttaaaagtttttactgttagaggtacgtaataaaaagttgaggaccactgctttaaagaaatttccatttggagagcccatgactcacatatttttaaaagtcaaagacaataatacatctttgaaatagcaatgttaactaaaattttgtttctacatataagctgaaaacagtaatttctatttgtagttgaatatgtcatcaatgtcttagattaaatcagtcaattggctgggtgcagtggctcacacctgtaatcccagcactttgggaggttgaggtgggcagatcacttgtgctcaggagttcgagatcagcatggccaacatgatgaaaccccgtctctactaaaaatacaaaaattagccaggtgtggtggcaggtgcctgtaatcccagctactcaggaggctgaggcacaagaattgcttcaacccaggaggtggaggctgcaatgagccgagatcacgtcactgtactccagcctgggcaacagagcaagactccatctcaaaaaaaaaaaaatcagtcaatcaaccaattagccaaccaactgacaaactcttaatccttatggaaattctcttccctactaactagacctctgaagggctcagtctcacaaaatgtctaccaaaaaatatctattcacccactgaacattaaatgaaccaatcaactctgcaagaaacatatgtagtgcaatattcacttgtctaagttactgacatcatgcagtggaaacaacaaattgagtgaatttgtgcttttcccacctataagcttatcaccattgcaaaaagacctccataaatcccaacagatgattaactcttcatcccaagtagcacaggctctcttgttaggttagaattaaagcatgatcattttgtgacagttattttacttctagtaaaattaatgtttagtacacgtggtgaaccacaatttgcctttggctgtttataatttcgaatggtagaaaataccaattattgttaaacacagataacactaggaatgatgagagaaagatgatgtccattttatagaatgattaccgcaaataacaattattgtcatcacaatataacaaaatgttaaaattgatctttttcggttttggtttctgtccaggcccagtaggtactgattcttccctcattctaaagagatgctagaccactaaaaatggaattgcaaaggaaatagacaaaattcagtttggaatcccttagttaccaccttcagcttataaaatgtgttgcagaaaccaagagaggggttggaaattagaagataatttatagagagtgtttctattgtgtatcatgtgcctcctcccccatgaaggggatactcttccttcacttcaagcccaacaaaatggctccactagggcccacagtaaactgatgtcaggatgatacctgagaaatttaaagtaggaaagacaggctagttagctgttctgatagcagaacaagatggagtctataccaggatggacctgacacttgttagagcaaagaacatggagaacttcccatgaagcaatagggaatgagataaaaaagacctagcatggtattgtttcagatcatgaccaagagacctcctggaggggtgggggaaatctcagcaaaatagaggctggatgtgttcccttggatgccagaggaaatgtaattgtctgtatcaaagactgctatgagaaattcctaatgataagcgggggttctccaaaggacctccaaaaacacatcacaagagagtcaggtgttggagacacgtgcaccaatgctagattgctagagcagaaccaggcttttgctggctcttaactcctcaccttcccttggcttcacttagaggaactgaaagtaaggaaacgaggaaatagcacattggcccctctttccccatagaggaggccagctttaatcaggcataagctggaagggaaaaggtgttaacctgcagcaaatttcttaaggtttttttaaaatcactattattattattatatttttgttacatgttattttactgagactctttgaggtagtaaaataagcagagggctttttgtatttttctgagttagtagaaaagttacagcgtccattgtattttcatccagggataaaaagaacaagctccaagaacagatttgaagggcagtagggggaaaatacgaaattattttctattgtgcattacaaatgctgcttgtacagcccaatgattttaataataatagctaaaagttatcaaatacttattatattccagacaatgtctgctttacatgtattaaataattttatgctcacaacaactctataagattattatagtaattttctaggtgtgaaatttagaagcagagagtgggtaaataaactgccctaggttgtgtgactagtaagtgacaaagccactcatgtggctatttcaagcaaataaaaattcaatctcttttcacaaattctttttttttctgtcaaacatccaaaatactggacatacaaaatataaaccaaggccatatcaaatttcaacgcattaacactttgcagagacacatgaggttatatgtgatttgctgtgctttatcaagaataagaagataaagcatttgctgtgctttatcaagaggccgaggcaggcggatcacttgagctcaggagttcgagaccagcctggtcaccatggagaaaccccgtctctagtaaaaatacaaaaattagccaggcttggtggcatgtgcttgtagtttcagctacttgggtggctgaagcaggagaatcgcttgaacctgggaggcagaggctgcagtgaactgagattgtgccacactccagcctgggccacagagtgagaacctgtctcaaaaaaaaaaaaaagaaaagaaaagaatgccttatcaacagtaaaacaatgaatcaccatagtacatgggtcttttctgaaatacatatttctcccttttaaatctctttttacaggtgtggacaaccactacaaaataaagtgcagctgaagggccgtgaccttctcactctaaaaaactttaccggagaagaaattaaatatatgctatggctatcagcagatctgaaatttaggataaaacagaaaggagaggtatgtaacattttctttttacgttccattactaccagtcccctttttttaaaggcagccttcccaaagaaagagggaaaaaaatacattaaaattcttaaacagtagctaagtaatgaaacctcacagtcaaggtaattgattatcatggagcatacaggcatacaaaaaagcataaaaatcagttattgaatgacaagtcattgcacttttttcacgtggaatgctgaaattcattattaactggatcgaacctaagaaatcatttgtctgaaaagcatttatttatttatttatttatttattgagatggagtcttgctctgttgcccaggctggagtgcattggcgtgatcttggctcactgcaacttctgcctcccaggttcaaggaattctcccgcctcagcctcccaagtagctgggattacaggtgcataccaccacacctggctaatttttgtatttttagtagagatggagttttaccatattggccaggctggtctcaaactcttgacctcaagtgatccgcccaccttggcatcccaaagtgctgggatcacaggagtgagccaccgtgcccggccaagattttatttttataccccttttcttttctctgtgtattttctatcaagtcaaaaatgaaggccaggcgcagtggctcatgcctgtaatcccagcacttagggaggccaggcaggcaaatcacctgaggtcgggagttcgagaccagcccgaccaacatgaagaaaccccgtctctactaaaaataaaaaattagccgggcatggtggcacatgcctgcaattccagctactagggaggctgaggcaggagaattgcttgaacccaggaggcggaggttgcagtgagccaagatcgtgccattgctgtccagcctgggcaataagagtgaaactccatctgcaaaaaaagaagatgatcctttttttccaagtgacaaattttaattttggatgcatatcagatatagaatcattaggataatgtcaaaaaattcacaatgatgtgacagcgttttaaaaagcatttagattagcaaagaaacaattaatggtatccaggtaggagaagagatgggatatggttcttagctataagcataattctgcattttgagcaatttatcttcgaaagacaattaatacagtagcttcatttggactgcttaattgtgaaagcatttttgtattccaagcttgttcagcctttttaaagagttggtttcaggttgagaaagtttgacacggttttgattttatctagtaggctggctctccaagctcctaagaaaaactgaggacaggagtgaccgcaactgctatgggttgatgttcctataaaacacctgaaataagagaaaaggtctccccaggcccaggcctatgttcttgacactttgtggatgagggaggttagctggcaggaatctatttgttccagaattccttctatcaggaagcccatctacagaagaggaaggaggaagcgccccaccccacattcagactctccagattgttttcaaatgacttccagaagcaaagtctttgtattcccatgaggatgcatgatgaatgtgtagctaaaacactagggcttcatcattgatctaagtgaaagttgtagtgccccatgttgtaacagagtagcattttcccagctgagaaaacacctccaaaccaaacaccttcgaggtcattgaaaactgaatggggatttcaatagagttaagtaagaaggtggttccagtatgaaatactaatatattttggaaaaaattcacatgttgaacccagaacaattaatactgctttctaattacatgtcaataagctgtgggagttactgttctcttcccccatttgtatagtacataaaaaaacattttaaattcacttttttttttttgagatggaatattgctctgttgcccaggctggagtgcagtggcaagatcttggctcactgcaacctccatctcccaggttcaagcaattctcctgcctcagcctctctagtagctgggattataggcacccaccaccactccaggctaatttttttttttttttttggtattttgagtagagatggggttttgccatgttggccaggctggtctcgaactcctgacctcaggtgatccacctgccttggcctcccaaagtgctgggattaaggcatgaaccaccacacctggcctaaattcactttttaaacaatattttaaacacttatttgggggtagttattacttattttctaataaagaatatgttttaaaacataatttatatataagatatattttaattctattcttgtccttgatttatagtatttgcctttattgcaagggaagtccttaggcatgatttttgagaaaagaagtactcgaacaagattgtctacagaaacaggtaagtccactgccaaattcacacttgtgttgaagagagggattgaaggtgaagactttggaggggtaacccagtgcggggatttgtctgcctctagcaaccacaaagaaaaaatcatttttactgggagcagcaatgcaagcctgtgaatgagatttccagttctcataaaagctgcaagcagaaaaattagcttcatctataagaattccataaggaactgagtagaagttccatataactcttcatgttcagaaaagaaatataggtgggcacacattttcaggccttgaactcacgtgggtaagaaatatgtctatttttctagcatgcaaagaacatttccttgtgtgtctcaattctgctagatggtggaaatttaatctttgcgatgttaggcaatcctcagttgttttatggtttattttgtccattttgggtctcctctccatttccccacagtcaggttaaatcatggagagtatctgaatgtcaagacatgtaggggtatggggatctggtccttggtcattagaacatcatcatcaaatatccatgctaggttctgttgggacttctatattcccattggatcttggctgtctcccacttactgcaaggtttgcttcactctcattgaaagaactcatattgagacaaccaagtataaaggggtcactggagaacctccaaccggcctgaacattgggaggaatgcacacggggctgaagcctcaggaagttcacaccatttgcgcggggaagagctggcctctcctgttccgaggtggaaactgggattcaatctgagaggcgggaagacaactagcaggactcttgctctgctgagagtccctgttttccttttttttcttttcacccgataaaccctgctcttctcacccttcaaagtgtctgtgagcctaatatttcacggttttgtgacaaggaccccattacaacaatatatctcttggtttcattctctcaacctcttagcagctctccaagacacattaggcacagaggtactacaaggctgcctctactctattgttccttcctcatgctgggtgccatggagctctataacatttactgccttctagaggtctgtcttaaaagcaagacaggttgtcctcagttctgggattctccaaactcatggagctttccagcatgcccccccatccttcagaagttgacttggggaacacatagcagagtacagtatcaaaggtccatcagtttttatttctgttgcttctcctctcttgcttctcttcttcccctttcagttcccagtattggaggccaggaaataaagcaggaggaaaaactggctctgactatccatggactcttccaaattgtgcctggaattctaggctgttaaggatattttttttcctcaagctattatctctgcagtttcaaaatggacactttgaaactcgtaagccacaaattgcctcttttctttctctctgcatttctgctctaccagacctcacttgaatcaataatatgactgcccaaatgagcaatcagacagggtcaaggaggaagtaccgcaaacaaaaacatattggttgatatttcaaatagattattctaccttacgagtgtcagagctttctagggcttagaagcaaacaactattacatgtgatttttaccttgcaatgattaataatgaagcttaccaaatagatatcaaaaagaaagttcagggggattaagcgacttgccaaattcactcaattaatacagatagcaccaagattcagatctgaagcccactattcttactaatgcacactccttccccctaaagagaaggaaggaggacgagggaaatatataaggtgctaatctttaaagccctaggaagaaaacagataagaacattttgctctttaaagctggctgctgtaagagatcatgttgatatctgacagatggtagggaaaaaatgaataaaccagtcagcaattctcaaattctgctccctttcaacactagtattccatgagttgggtagaattttattttatttcattttatcttgtgtgtatatatttttgtttttaccgttagtacttaagagaattgttcttttttgaagtcaccaaaataattgtttaatacatagaaatttctcaaatttaagtttttttaaaagggattttgctgagttcatggcatttctatgacttttccctgttcaaatgttatgtttgaaaccagaatatttctgaataaatgattggtttcaccatttataataatgtggtagttaatctattaataaaaatgagagtgacaatttaataagtttttggaggcagaccctgtgccaggtgttctacattaattatgtgtgttatctcactcaatcctcatggcaactctgtgagagcaagaccattcaggaaaacaggctgaaatggggccagcaaatggctcaaaggcacgtacctaataaatggcagacccaggattggaagctattactatatatatttttaaatacctaatttaataaactaaatctattgatttaatttaattatatggcatgtaatagtcatgttttcttctagtaaaattgtttctactggtggcattaagcattttgttaaatgatggttttctataaagaaatccttagaaacctgccccaaatcgtaaataataacaacaaataaatgaagcaaggagagtatgactgttaaaacttatagttcatggagcatttgtcattatcctcaataattgcatatggcatcctgccaaactcaacagtagaatcactgaaagcgagtagctgtcttaattgtttacagaaacagtaaaccccaatcaaaatcatgacagaacattcctattgtgagtatgtgcatcttaacagttgtcctttggtacaatttttcaacaagtaccacctgttactttggtgcttagaattaaaataggtgtaattataactgttactgccccaaatctgtgccagcccctgacatgatcctcacaggacagtccttggcaattctgttccaagcctgagtttcagagctacgttcacattcctacttatctcaggagacagaatcaaattctccacccaactctgaccatagtaattgtttatgtaacatgtttattaaagtgtaacacacaaacagaaaagtgcacaaatcattaagcgtatagatcgatgaattcttacagtgagcaaaccattgtaactaacacccagatagagaaacagaatggtagtagcacccagaagcttcccactacccttcatttccttccagtcactactcctcattcacccaagggtaactattatcctggcttctaacatcacagattcattttgcctatttttgaactttatattaatgggatcattcagcatgcgctcttttgtgtctgacttcgttcgcttaacattatgagatgtatcgatgtagctgtgtgtagttgtagatcattcatgcctcatccactctttgtgtgtgcctgcctggcaaaccagacaattctcctatgagtctaccaatgataatattcttttatagcaaatgaattgagctgatagacagatacatttattaatctcagtaaatgcagtagctgataaaagatgcaaaaggcattctaagagatggttcttttcattatttaacattggtatttcactttcaaggtgaaatagaaactggtgttttaacggctgtttcaaaatcatcgtctgtacaaagatgccaatgtaaaaattgtgatactattgtgcaattataaaagccaagcacagagaggttaataactgccttagttctaccagcaaaggtactcggatcccttatatttccaaggaatgaattctatttatactctttttaccaaagcaggcagggatctatggggaagtaaaagagcaaaataagatttacttttattttcccaaacagaaattaagaaattagcagaagaggccgggcacggtggctcatgcctgtaatcccagcactttgggagtccgaggcaggtggatcacgaggtcaggatgtcgagaccatcctggctaacacagtgaaaccccatctctactaaaaatacaaaaaattagccagacgtggtggcgggcgcctgtagtcccagccaatcgggaggctgaggcaggagaatggcgtgaacccgggaggcggagcttgcagtgagccgagaacgcgccactgcttccagcctgggctacagagcaagactccatctcaaaaaaaagaaaaaaagataaaaagaagaagaaattaacagaagaaacgctatgttcaaaaatagctgatgtgaaagcataaacaaatgaaacaggtaaaagcaggcttctctggataaagggtggagaaagagtggaagcccatctctctgtcctcttctccttggcaatggcagcttctagtggctgctcaaaacctctgatgcccctcataagcacgtattaccatccagacctggtaaaccggcaaattcttgacttgtgcttttgggctgggatctgaggcttctttttgatctgtgacaaaaattgcaaaggcaatttcttctcagaggtagtatttcctccccatttaatctttttcatgaactgctgaagtctttggctcctgcctgtacacactttctgttactcttcttcctacccctatttcataagtccaagcaccgtatcgatcttctgtatagcacaaacagggaagtagaaggacagcagattaatcctgagttgctatagcaaaatgacttatcatcaaagaaagagtgtgacttggaatagacctaccaggaggtccgaaactttgtttgaagtcttcatccatagtcctcaaccctcaatggtactcatacttgtactaggcacttagtaggtgcacaataaataattttttgacgaatgtgcggtatttatgtgtatttaggtgacgttgcatgtttataaagaaattaagtactcaagagtgattagtgattataatcaccactaaacttcattacgttgcttcatagataatagaaatttctcttctttctgttagcaaaatgagaggctgttcacaaatgagaagaatgggtcctttcttcagagtcaaattcctcctttattcattcaatgagaattcattaagcacttactatttgccaggttttattctaggtgctcgggagtgatacctcagtagacaaaacagatgaaaatccatgccttcatggggcttacattctagtgggtacacagacaataaacaacagacataataaataagtggatgatacagtatgttggaagatgataagtactctcagcaaggagaagaatgtgtctggaactgagggaaaaacaagtgcaccaatattgggactttggctttttggggaatcgttggatgatcttgaacaaaggagggacatgatctacttgcattttaaaaggatccctctgactgagaataaactgtggaatagactgtggggagcccagggtgaaagcaaggtagaagtagtgaagcctgtcaatagatagctatcaattatagaagctggggttgtggtggcagcagtggagagggtaagagtaacagatcctaggtatgttttgaagagagagacaacaagattactgatgtattgggtaagagagagatgtcaaggatgactttaagatttctgcctgagcaaatgtgaaggctggtgatggaacaaatggaaaggggaaggttgggaattcggtcttagatatattgagtttgaagtgtctattagacatataagcaaagatgttaaaaaaaagcagttgcacatgagtctggaatttgggagtgaaatctggcctagagatatttgagtgtcaccagcatatagatgatatttaaggccatgggactggatacaattataaagagagtaagtgtagattgaaggatgagaggagaaccaagggctagtcctggggcacaccaacattcagaagtcaagaaaaatagaaggaaccaacaatggtgactgagaaggagcaactaccaaggtagatgcaaaggcaaacaggtgtgatgtcctagacactgtgtgaagaaagcttatcaagtagaaaatgaagatcaactttgttgaatactgctaagtgaaggaagagggctcagaaatggccactagatggagtaacgtgaaggtcactgataactttggtgagaggagttttggtgcagcagtggtaggggacaaagccttataggtttgatggaaatgagaagagaggaactagaaaaagaaagaagaacaaagagctttgctgcaaaggggagcaaacaattaaaggaatacttgtcagggaaattaggacaaagagaaatctgtatctgtttttaaataatgtgtgaaaaatgagaacaacccattcaagatgttggtgacataagggagaaagggaggaattgctagagcaatgtctttgagtaggcaaggggagtggcttctagtgcacgagtgaaggcattacatggggcatggaaaattcatctatgcttaatagaaaggaaagcagagtatatgagtacagatgctgactagtcgggaaatggagtagagtctggaagttctcctcttattcctgtaattttttcagtgaggtagaaagcaaggtgaacagttgagaagctcacttcacctctaaagacatgcatccactgataatgaagggatggcaaaagatattccatgcaaatggaaactacaaaagagcaggagtagctatacttatatcaggtaaaatagatttcaagacaaaaactggataaaaagacaaggccattatgtaatgataaaggggccaattcagcaagagaatataacaacaataaatatatatgaacccaatgctagagcacccagatatataaagcaagtattactagagctaaaaagttaaatagaacctaatgcaataatagctgaggacttcaacgctccaccttcagcattggacaaataatccagactgaaaatcaacaaagaaacattagacttaatctgcactgtagaccaagtggacataatagatatttacagaacatttcacccaacaggtgcagagtacacattcttttccttagcacatggaacattatcaaggatacaaaacaagtaccccaaatttaaaaatacttatattaaatatattttctgaccacaatggaataaaactagaaatcaataacaagaagaattttggaaaaaatataaacgcgtggaaatttaaaaatgtgctcctgaatgaccattaagtcactgacaaaattaagaagaaaatttaaatagttcttgaaacaaatgaaaatggaagcacagcatattaaaacttgtgggatacagcaaaagcagtactaagagggacatgtacatcaataaatgcctacatcaaaaaaatagaaaaacttcaaataacctaatgatgcatcttaaagaactggaaaagcaagagcaaaccaaacccaaaatttgtagaagaaaagaaataatacagatcaaaacagaaatatacaaaacagagactaaaaaaaataaaagatcaatgaaataaaaagttggttttttgaaaagatacactttcaaaacataggaagaagccaaccattttctcaacacgttagctgctaccaccttgttccagcctatcaactctcacccagattttcgcaacagtctcctgacttgtctccctgcttttgccctgctacagatgtccaattaaaatgtaagtcaaatcatgtccctcctctgctccaagccttaaaaggcttcccattttatccagacaaaagtcaaagttgttgccttctccccagcttccttctgcagcctcacctctgcaccgtccacactaccttcttgttgtctctctctctctctttcttttttttagacgaagtctcactctctcgccctggctgcagtgcagtggtgcagcttggctcactgcaaccttcacctcccgagttcaagtgatcctcctgcctcagcctcccgagtagctgggattacaggcgcccgccaccatgccaggctaatttttgtatttttagtagagatgggtttccccatgttggccagactggtcacaaactcctgacctcaggtgatccgcccaccttggcctcccaaagtgctaggattacaggcgtgagccaccgcacccggcctcttgttgtctcttgaacccaccaatcatgaccttcacacaggaactttgcacatgctcttcccactatctcgtatgttttctatggttcacctatccatcttcctcaggtctttactcaaaagtcccacaatcattgtggcttccttgaccatactacttaaaattgcaacttgggtcctgtaaatttcctattctccttccctgctctgtatttcttatagcacttatcagtatctaacatacaatatatttaatttactcattcagtttgtactctgtctctccccatttgaaagacaaaaactggaaaaaaaagacaaggccattatgtaatgataaaggggccaattcagcaagagaatataacaacaataaatatatatgaacccaatgctagagcaaccagatatataaagcaagtattattagagctaataagtagtcaaagacttgtatcttgtttacaatgctttcttcagtgcctagaacagcaccaggcacatattttcagaatgaatgaatttcagaatcatacagtgaggccaggacttgttgtgttgtgtagttactccacagacatgagatgtgccatccacctaaaatttggtttggttgctgacagtgagaatatctcacatgcaccaggaagatatgaaaaagtttattactcacatcatgtggctttctggggatagtaggtctggtttccaagcaggtctgaaagtagccccagagagcagagaaacgatatggagttctagtgtgatttggcgatggggctgggatgaggattcccatgcgcaaggtagggcttgtgcagtttgaacctcctgctagtgccaaaggagtgagcacctgaactttcttatcagctttcccagatgtagggctgaagggtcaggcagggagaggtggacagtcaaacatcagaaatggggtcagaatgttcattacaggtcccatagcaagtaggactgtttgggcatttcatattctttgatcctacctggcacctagcacataagatttgcaagggatcttacaactctaggcaaactgtcttctttttcagatgaagaagactgagtccagtcccactatgtcattctgtctctgtagatcacactttgagctgactcaatagctggcttccctatggcaaggcctagggctgtggagacttaaaaacaatcttgcgcaattttttagactctgactctcagaacccttttctataaaattcttgtaatatctactgtacactttgtcagactaagggattcaatgaaagaatgttaataatgtgccatcatatgattatgctctgtgaagagtcattgctagggtcagaacatggtggtctctagttaaagaccatttggtctaggcatatttaagagaacacttttgagtataaaataggtagactataattatttaattttatatacagtaacagaaatgaggaccattgctttgtgtgggtttgatttttaatatttttttttctttttggagatggagtcttgctctgtcacccagggtggagtgcagtggcgcgatctcactgcaagctctgcctcccaggttcatgccatcctcctgcctcagcctcccgagtagctgggactacaggcgcccaccaccacgcctggctaattttttgtatttttagtagagatgggatttcaccatgttagccaggatggtctcgatttcctgacctcgtgatccacctgcctctgatttttactttttatagtgaaactttcaaataaacagaaaagtaaaaagattagcataatgagcataccaataccctttacatcagtctaacaattgttaatatgttgccttcttcgtctacttgttttggttgttgaactaaagtaaattaaagttacaatgatattttaccccaaaatacatcagtttgtatccccaaaaaataaggatattgtcctatatggctatgatgtcatgatcacactgaacaaaaataatgattccttaatatcatttaatatcagtccatattcaaactgtgttaaggcttcagtaggatgtttcatgagattttgagtcaaattctcctttgtggatctgaaactcctcattccccaattcaccgtgcaattaatgatttcttccctgtttatgggaaacagatgggattagcaaattgtgactgttgcttatttcccaaaagataaatcaggcacatcataataaggaggggaaaagtaatgtttgtaaaattccttggacaaatctctatcttgcaattatgtgtatttgcctttatgtattggagaaattctgagcattaaaccagtctcaaatgagacagtaaagttctgattggatgtcaccatctcccataattttccccagaatgtgtgatgaaagggctccagcctgggtgacagggaagactgtgtcaaaaaataaataaataaaaatgaaaggcttgaaaataaaagaaagtaagcattgagatagtggtttcaagtcactaagagtaaaaaaagtaaaagggccactttactgttttccttatcttccaatcaagacagcgtcatatattttattttattttttatttttttcagacagagtcttgctctgttgctcaggctggagtgcagtggcatgatctcggctcactacaacccctgcctcccagattcaagcgattctcctgcctcagcctcccgactagctgggattacaggcgcctgccaccacgtccggctaatttttgtatttttagtagagacagggttttgccatgttggccaggctggtcttgaacttctgacctcaggagatccacctgcctcagcctcccaaagtgctgggattataggtatgagccactgcacacagccagctttatatattttagagaaccaaaaccaggcatagccccaaagagggaatgatgcctcgttattgccaggtcttgaataagagggtggagaaatgggcacacatgtgaaggagagttaattacttgagcacaaaattttatctacttccctcaattcctcattttgctttgcatgggaattctgtatcagagaagttggagagctttaaagattttgacttttcagttgagatgatgccaattctttgtaattttgttttccactttagttgttttttcaaaatgatttttttcttttttttttattgtaggctttgcacttctgggaggacatccttgttttcttaccacacaagatattcatttgggtgtgaatgaaagtctcacggacacggcccggtttgtaaatattttcttctctccaaagctgatttcagaatctgatggataaatttcaaaaataaaacataattctctttaaataatggttttccctctaattgttctgttctccattttccctctttccctgatattctgaatacctctccctcatcctgtggccactttccatcggttgaaataatttttcttggcaattttttgaagaagcttctgatcataaaatttcaaacttatggaaattttgagttcatcaagtatgactcttagatttaacagttgaggaggaaatgaaggtccagggaaactgacattcagtggctcataactagttactatcagactaggtaataatattaataactactaataacacttattgagcatttattgtgtgctaggtatttttctgacttgtttaatccttataacaacccagattgtcataaagaagtgaaacaacttaattaggcacagactagctgctataacacaaaatctcaaatgtcaatatgctaacatagtgcagatgttcctgattggtaaaagggaagaacaggttattaatttatgtgggttattcagggacactggctgagagtgattctaccatcttcaacatgtgacctccaaggtcagtttgggtgttaacatccagccaggaccaaggagaatagagcatggagaaggcatacttgtttcaaagccaccttagcagggaagcagtacaaacaattccacttatatttcattaggaagtactagtagctcactcccatctagatgaagggagagacggggaaaggctcttccccactatattataatgaaactgaagcataggcctcctgactcctcatgcaatgctcataccactacatcatgtctggctaaaaaatccagagcaaatgtctttgttaaaagttttgccctcaaaagagaagactaatgattcttttcctgaaaatgatacgccatgaagttatttcttgcagataacgtctgctttttatggcaaccaccctagtataaagaattcacctcatttgacttgctgaagagatttcaaataactcttctttaaaccttttagttatgttatttcagatgggacaatgaaagtattaagaagtgtgattagcttctggattctagggacaaaaggaatcaaggaacataaattttttcttccaaataatctgcctctgacttggattatatttgtctgataattctgcttccacaaaagtgaaaatatactttattcaaaagcaaatattacaagctgatcaagggatgaagccagagacatacccaagcaaagtttcagtgaggatcctctatataggaccaggtgaaagatggtgaatgagtcatatgtaaagcactggttggaagagggttcagtgggaggaacagctgagcatccaaaaaaggagttgagcagtgcaggttggcagtcagaaagaggtcaggatccagaaatcagtgcagtgggcaggatcccaagatcaagagacaaacagccaagcatgggctgaaaattgaggatgggtataaacgtgctcttttctgggcttgctctccacacaattctcactgcaagtccttagttagaggagctctacatagatgctgagcaaaacagtctgcttacagttttttttttttgttacaagttccaaaatgattgggacattttgagtccatataattattatagttccattgctacatgaatacatgggtccatgaaatggagtccatataattcattttgaccattttgtcttatccaaaacactgaaaataatagctactccttaaagattgtctgccgtggacctcttgtgctattatctctaaatcttttttaaaatcttgcaaagtaagtattattggcctggttttatagatgaggaaagcatggctcagagaagttaatggagcttagaagctgactaagtcagggtttaaatcaagctgtctttattttctaaggccgtgttgttttgattaccccataatgctgcttctattcagcccacgagaggggcagcgaaacaagttatagaaaatattgggctgggcgtggtggctcatgcctataatcccagcactttgggaggccgaggcgggtggatcacctgagtttgggagtttgagaccagcctgaccaacatggagaaaccccgtctctactaaaaatacaaaaattagccgggcgtggtggcgcatgcctgtaatcccagctactcaggaggctgaggcaggagagttgcttaaactcgggaggcggaggttgcagtgagccgagatagcgccattgcactccagcctgggcaagaagagcaaaactccatctcaaaagaaaagaaaagacaaaaaaaaaaaaaagaaaagaaaacattgacaacattgacttgcacgtcaagaggtccccaggacaacccagaggtttgatgattcactaggagggctcacaggactgagcatatagtcatactcatagttatgatttattacaatgaaagtataccaagcacaatcaatgaagggaaaaggcagaagcaggaaaatgaaaggagtttctgctttgtggagaaaatgacagattaggcactgaacatattgcattaaagtttgaacctctgagtgcaaatgttcacaagtcattggagataaagaccttgagtgaagttgagagctgaagaaatataaatataagctcggtggtaaaaattacctccatggtctcaatgtgggagaattgcagaaggctgtgccatgagaacaggtgcaattaaggagggggaggaggaaatcctcagggcacaaagagaacaagcatagtacaatatcagaagaggctggcatgggagatgggggatgtcagaaaaaggagtagagtagctattgtagaaatctgactttcttttgtgtacgtcattactgcttaatctgccaaaatatctgacaaacaagatatgctgggactcagaaattcaataaagctaaattgaagaagacaagataaatctaccaccttccacagatgcaattgaataggagatgtaaggaagcaaatcttaatgacatctaccttgctgatatgcaccttgtaaccctcagcaatcgcttcctttgctttttgtagaagtttaacattttaaggtgcaaagggattggaggatgattaaatgacattgctggccctttcaaatcaaaagaatcatgcatgcctgacactgattgacggtgttgcttcttcattgctggtccagctgctttgggggcctggtcgaataaaaagtgcctgcacattgttgaaagaagagcctgagggagaatatagtgagtgtagcaaccaaaagaaaaaaaaagaaagaaagaaaaccgggccagtctcttgaaagctgttaaatgcaatttccatagtgccacttatttgttcaaatgatttaattgttcatttattcagaaatagttattgaatgcctcatttttcttccagacattgttttagcactgagaataaaatgctgatcaaggctgggtgcggtggctcacgtctgtaatcctagcactttgggaagccgaggggctgggggaatgggggtgggtcacctgaggtcaggaccagcctggccaacatggcgaaaccccatctctactaaaaatacaaaaattagctgggtgtggtggcgggcacctgtaatcccagctactcaggaggttgaggcaggagaatcacttgaacccgggaggtggaggtggcagtgagctgagattgtgccactgcactccagcctgggcgacagagcgggactctgtctcaaataaataaataaaataaaatgctgatcaagtcaaacaagtttcttgttagagtggaaattgcattctggagcgaggaggcttttgctaaacaaatgaacaaagcatgaatagaagagcaggttgaaataagtgctatgatgaagctaaagccgggttatttgttggtggggtggcggctgccttagattgggtggtcagggaaggcctctctgaggaggtgaaagttaagagctcaataaaatgacagagccaggtacgcaatgctgtaggaagagtgtcacagaaagaactgctgatgcataagcctaaggcagcaacaagctggatgtgttcaggaacagaagggaagccattaatgttctaaaatcttcaaacaaatacattttgaacctgatttttttttaaaaaagcaccttacagattggtcctcagtctcacccaccaaagaaaggaaagataaaatcagaacaaggaataaaaatcctaaatacacattcaaaatccaatgtattgtacagcagatctttagaacttatttatggccgggtgtgttggctcacgcctgtaatcccagcactttgagaggccgaggcagacagatcacctgaggtcaggagtttgagaccagcctggccaacatggtgaaaccccatctctactaaaaataaaataaaaaaaattccgcacacctgtagtcccagctactagggaggctgaggcaggagaattgcttgagcccaggaggcagaggttgcagtgagcccagatcctgccactgcactccagcctgggcaacagagcaaggctctgttaaaaaaaaaggccgatgcagtggctcatgcctgtaatcccagcaccttgggaggccaaggtgggcagatcgcgaggtcaggagtttgagaccagcctgaccaacatggtgaaatcccgtctctactaaaaatacaaaaattagccaggcgtggtggcgtgtgcctgtaatcccagctactcaggaggcagaggcaggagaatcgcttgaacccaggaggtggaggttgtagtgagctgaggtcacagcactgcaccccagcctgggtgacagagtgagactccatctcaaaaaaaaaaaaaaatatatatatatatatgtaacttattcattcatcttctataactgaaataattgttgaacagcaatgctcattgccccccacctccaacccctggcaaccaccattctactttctccttttatgtatttgactattttaatacttcacataggtggactcatgcaatatttgtccttctgtgactgacttatctcacttagcataatgttctccgcgttcgttcgtgatattgcatatgccgggatttccttctttgtaaggctgaatgatatttcattgtgaatatgtaccacattttctttatccattcatctgttgatgaatacttaggttgtttccacttattggctattgtgaatagtgctgcaaggaacacaataatacaaatatctctttgagtttctgatttcaattactttggctaaatacccagaagtgggctaaatcatatgataattctatgttcaatttttcaaggaacttccacactgtttttcatagtggtggcaccattttacatcaccaccaatggtgtggaagaattccaattttccacatccttgtcaacacttgttatcttttgtcattttgataatagtcatcctaacaggtgtgaagtgatattgcactgtggttttaatttgcatttccctaattattagtaatattgagcacattttcatataccttttagccactcgtatgccttttgtgcagaaatatctattcaaatcttttgcctatttttttaattttgacttttatttttttgctgttaaattgtaggcattccttatattttggacattaaccccttgtgagacacaggtgtgcaaatattttctcccattccataggttgccttttcactctgttgattgtttcttttgctatgcagaagctttttagatctcatttgaagtattattacaataaaaaagtcttacatttagagttagtaagattttaaaaattagatcataataaacaagtatcccaaagaagatctgacaattaaggagagaaaaaactgtattgttcttttcttccttgttacaataataaaacctattcactatacagaatattgtggctgaaatctcgttagcttggtctgagttgcattttgtataatctagaggtgactgaaggggagcactgaggtggagctgtccactgatattttggaggagctgatatgttggagtctctaacaccacactcaggtttgatcatttattggaaggactcacagggatcagcatacagtgatactcatggctaagatttatcacaacaaaagaaacaaagcaacatcagccaagaaaaaaggtgcatgaggtaaagtctaggggagactaggcacaagcttccacaagtcccctcccagtggtgtcacacaggatgtgcttaatttccccagcaaaccagttcccaaggcttttactggggactggtacaaaagtgccctctgcctagtgtgatcccaaattccagacacccagaaggaaagcaggtgttcagcataaaacatagtgcatatccaaacagtttgggcacagtggaccacccttctcatttctgggaatggtgggaaccctcctaaagtccaagttcctagatgctagccaagggtcagccttgtaagcagccctttgaaggacagccacctcaaggcgctatgttagcttttttctgcataatcaggctctcatctctcttctgaattttgctcaatttcttttacctagatgtactgtaactggtaagggagtgtatgttatatccatgggaagacagccttaagatttgagttgttttcttgcttcagcatggatccctggaggcctaggttcccctggatagaatcagtcctattgctcacttccctttattgaagagtctctcttaggagctccttctcaccccctaacatatcagaaaacacaaaacatacacatagatattcagttaagtttacttcagatgtgagggtattttcagattttgtcatttaccaggtgctctactggggttatgaactggatattctttttttttttttccttgttctgggcttgtccttttagatgtgacaccagaagtgaccaccttcgcgtgactcagatcactgattttttagaagatttaaatcatatggaatttagcaacagcaagtggggcattatcactccagtttcaaggctttctgtttcttctgtaatgacagcttttcatgcctaatgctcagcgtactactgaaaagtgcataatagcttcccagtcatttgtcttctaatatagtacttagtaatgcagcttcaggaaccacgtgtatgaaaggctccatataaaaccaaataatgtaacactgttctactctaatttctttccctatagatgtaatttacttatggtagtgattgctaaaatgtgttcagctaatttgtaaaaccagtagaaaagaaaatgaatgtagaccactatattagtttcctatggccaccacaacaaattaccacaaacatggtggcttagaacaacagaaatttattttcccacagttctggaggctagaagtccaaaatcagtgtgtcaacaggaccacaattccctttccagtggctttcagtcatccttggcattccttggcatcaccccaaactctgcctccatctttgcctgggcttctctgtgtatcttctcctcttcttataagaatatctgtcattgaatttaggacctaccctactccatatgacttcatcttaactaattacatctgcaaatatcctacttctgaaaaagctcacactttgagtttctaggtagacatgaattttggggaaatgccattcaacccactataaccacatatccacatgtccctatgacaccataaaaggggtttccaatcattgctattctcaaataatgaaagttatagagggatttgtggatgaggcccaatcctcaagaggagtgaaccattgtcatattaaaaggaatatttataaaaaaaaaagctggaatactgttattcaggtatttataccaattatgtccagactaaaaatgttaaaggttttacgatttttggtaaaatgttttaaaatattggtacctaatgggaaatatatatctcatgaggtagtaataaattggtacctaatgggaaatatgatacttccatgaatctttacagagaacaccaagaacccagcaggtatgaaaattctatatttttgggaaaaatgattacaaaagacagtctctcacaccatgaacaatgatatattctcttagaggcagtgtaccagagcgtcaaggacaggggcttcaaagcagagtcacagtttggttcaattcagagctctaccacatgctagccctcatggtttgggccagatgcttctgagtctcagtttcctcagttgcaaaatggagatacttatacttatcttaatgcattatatgagggtaaatgagatcgtgcttgtaaaggacacacgcacagaagaaattcaagtaatgttggttgaatcaagttatgatctaacccaatctcaagacaagcactgactcaattttggctatctctgtggttttcctaaacaggttacactgacccactgaacttccattagcatattttgaagaagttattctaaatgccattataccccattcatttttctctaaggtcttcaaacttgggatctaacatttaaatcaaaacaacctggccattatagatccttcattaataaattgaatatggcaattttattcaacatctctggcttcttccaacaccagcccatttgacaagaacccatctaggtttgctgagagtattatctatcttatttcctcatcattcttatgttgatataactaaaatcatctgggtagagatgccagagggctagaatattctgtttcccagagggagattcagagagtttatctcataatcaatttacattggggatagagattaagtctgcttaagtctccttttgggacttggctgaatttgacaaaaaataaaatcagaaacatccatttttaagtgattacagggttctcaaggatgtaatatgcacaaccaaaacatccttcctctatctcccagtcagctgttcaactggtaagagttgtcagtgaaagaaactggagtttagagggcatgcagtctgattcaaacaaggcaggatggagacaaaagagaaaatggataacaggaccctatgagaatacaacctctgtttgcctttggcttttgagacacttgcaccatgttccaatactttaggaacaactgaactccttttaagagcaccaggattgctgtatgattgtccatctcatcaacatccatgtttgctcatcaacatccatgtttgatctggcccagcacactacttgttttttattttttagtgtttgttcacccaaccacactaactctgcaccaggttttcctggggtcatgagaggctttgtttattgtctttttttgtttcattttgctttgttttgtttcagccttcagggtgttttcattaattcctaaataagtttcaaacttataccaaaagaaaaaacaccaagcaacaacagaaactaagggttggaaaggatttatttatagcaaccatccttttcatggagagagtgaccatcactctctcaaaatggtcattgagccctgcataaatcatcccatcattctcagcaaactattgcaaggacaaaaaaccaaacaccgcatgttctcattcataggtgggaattgaacaatgagaacacatggacacaggaaggggaacatcacacaccagagcctgttgtggggtgggggaaggggggagggatagtattaggagatatacctaatgttaaatgacgagttgatgggtgcagcacaccaacatggcacatgtatacatatgtaactaacctgcatgttgtgcacatgtaccctaaaacttaaactataaaaaaagtacccagtactaaggcactctttatatactcagctattttgtctgatatctatgtagtctgactgttctcatcaaaagtttatacaatctgactgagaattatctttgaaattgagttagaattggtcttgctatgattcttctcattgttctcccattttattagtatctttataaactcattggatgctaatacatttgaaggtttcaatttattataattattattcttattaattatcaaattgtcccatatttggtcaatgtcatctttgttcaagttgggtcattttgacctaactccatcagtcttcgataactctcttgctttgtggtgtgacaagatgttccaggctcatcttgtacatttctttattaagaccaagaattagccattgctctaagaagacttggggcattttcaattactttcaaagtcacacttgggagaaatttcctttcttgaatgatattttgtctgattattaaaataatattccttttgatagaatatactaaagaagattaaaaaaatagagccactgataccaccatcatccagaaataatggatgttaacattttatctctggaaccatctttccacttaaagtttcatgccgtgcctttcctttttctaaacagtaggaaaagagatgatgaatgaaactagacattttaaatatttagacaaaataggttgaacacatgttttaacttgttaatcatttttgaaaaatcctaatattggccattaaacttccagggcaagctggtatatgtgggaaactttaaatttgagtaatttggattttgcaaaagtctttttgctaccattgttggctaatgccaaagattgtctgcagagctgtaagaatgcactggaaggcaaacagtactgtatatattaatagaaatgaaaagagggtaaaatgaaaagtcattatagaaccagagagtatttttttaacttatcaacttttcatgtgtagcatgtataataaagctcttacaatgtttaaagctggggttttagattgatggagagctctataaatcccagattactattaatgtgcttgtagtccagctctagttacagggttgtcattgtttccagtgaaaaggtttgtttttattttttaaagatctttagtagcctggaagaattaaaatggtgatttctagcaattttaagcatgaagtagataccaatgtcattcacaaaataatatgaactaattgtctagttaagtgtctttaatatctttgttcccctaagtgagtccaacatgaaagcaacctaggagctgctccctctccacccccatatcattggattccaccttactcgaagctcctgtggctgaaagaggactaaagtggcattttctgccaggctttgtcacgctcccttttgcccacaggtgctttaacctccaaggggctttttgtgcctacagggatattccgcactctttgtcctttgtttacagtccaatttcataaccttatgaatttgtcaaacatttagcattttttaaacctaaaataataaacgttcctcaaagcacagctaccaagtcaacggcgtaaatagcccttgggagcttttcagaaatgcaaattctcaggcctcaacccagacctcctgaatcagaagcagctggctgtattttaccaagtcctcctggtaattctgatgcatattcaaattttcattgctttaaatattcacacactacttatacaaccaataaatcaaatgtatattaagtgaacaaaacgaatctactcaaccatttacacattgattgcaaacttaatgaaatgcttttaaacatttaacttaatcacaagcctaacatttcagatttccctgcattaaacatcttacaaaggaaaaaatacacgtaaaataccacgttgtttacatagccgattattattttgacaacaaaactgggcacaaagctattaatatcatagatttaattttgtttttttattcttaaatctccttttatttttacttttgtatggtcctggaatttaaacttctgtacattgctggattgttgggaattctacaagagactctttatactttctcagggtttatgtaatttttccagactggaaagaacaaacatatcacctcgggaagtcagggatacaggttaagtggattactggccacttaattttggttggttagtgggaacgggttgctaaattcaaggtgacttaaactcaagttgctggccactagacaataattttttatcacatagtttttgttttttgtcatggaatctatattgttttctcattgctgctttaacaaattaccacatacttagtggcttaaaacaatacaaatatattatcttacagttctggagggcagaagtctaacatgagtgtacagggctgtgttccttctggaggctccagaggagaatccaattccttgtccattccagctttcaagggctgcctgtatccttgggcttgaggccccctttttccatcttcaaacctagtgtcttcatagcttctcctctcatttctaacctcctgcctctctcttattctctagtgttatattgggcccacccagggtaatctccccatctcaagatcactaacttatgaatatgaatcttcaaaattccttttgtcaagtaaagcaatacattcattggttctgtgggttaggacatggacatctttggggaccattattttgtctaccacatgacactttttgtcaatgtatttcacatttttactgtgcatacacatatacacaatgtattttttaattaggctttacaatatataattttattgcccggtttacaactaaatatattgtgaacattttcttttcttttataacagttaaaataattgcatagtttggagaaaacataatttactaagcaatcttgttggggaaatttaggtataatttttttccaaggagatttcattcttttacaatgctgttagaaaaaaggagagtctgtcttatataactttctatagatgatggaaacttgcccttcaatttagccttttaacttgcttctctacatccacctaatcatcagtcaagtaattcattttcttttttcgtgtccatctctcccatttgcttcctcttttttaccccatctccctggcacacatgcagacagatttctattactaccccagcgctttctgatccttccctccatggcctccctttaatgaggctttctttcattttaaagagaccattttaattgattttgatcaactctactcaaaactttatcctcagtttcgcattaggattagcctttaataatctgaagatataattcaattgtttaaaagaccgtgttaataagaccttggtagagttacatgtatcaagaaacataggacttgggcacaatgtacatacggctgactttcttttgaaaaaggaaagtagtttctgggggggggcagggcagaggtaagaagtaattggtacgtgaaggaagtgaggaagtgttagggaccattatggaaatgtattctttttttgttttttgagacgaaatctcactctgtcacccaggctagagtgtagtggcatggtcttggctcactgcaatctccacctccctggttcaagtgattctcctgcctcggcctcctgagtagctgagactacagtcgcatgccaccacaaccggctaatttttgtatttttagtagagacggggtttcactatgttggccaggctggtctcgaactcctgaccttgtgatctgcctgcctcagactcccaaaactgtattcattattttaaggcaactaacaaatgatcttctttcagttaggacattggagcagcagactttactggtcatgaaatttgcatgatatctaaagttgttatttctggaaataggtaaatgtcagttcatagtaactttgtatggaaaggcatgtgccagctagcataaaagtggtacatgcagatggtagttttccagagtcctgggagccatgaggtgctcaaacatcacaaggccatcacaaccaggtagaaatgcctcaggaaagcagaggggttggccatgccagcatttacacataaaacgcttcttgggcagccagatgacatggtgcacagacccacagttctctctgcacacaacatgctcacagttccatccataggaggaagggaagacacaaaagcaccccagcgtgcaggttcccccatttggacagcaggttctgttttgttccttactgtcctgtgtccccatggatggcacaaactctgaaataaggatgaattgcaggctcctcctggggctgagtgctgtcccctctgaaagccaagtcttcctgagatagacatgcaagttatggtggcccaacccaacctggccaactaattctagttcaaatgcttttgaaatggccatgatcaaaattacactccgtcattgtcccctgaacgtttaggcaggccagaggatgagagagagcagccgtatttttatcttttaaattgattctgtttttttttttttgagatggagttttgctcttgttgcccaagctggagtgcaatgcagcctctgcctcccggattcaagtgattctcctgcctcagcctcctgagtagctgggattataggcacatgccaccacgcccggctaattttttttttttttgtatttttagtagaaatggggtttcaccatgttagccaagctggtctcgaactcctgacctcaggtgatccgcctgcctcagcttcccaaagtgctgggattacaggcatgagccactgcaccctgccatggattctgatttttaaagaaatttagaagatttaagttttgtttgtttttaatctctggcagcacatgactcattgcaatatttaataatatattaacctggcctggtttcaatatttaaaaacattcatctttcttattggcattgtgttgtaattaattagttaaatcatcaaaagttttcatttccagagaaacagaaaagtgaatcttaaaatttagacttcttagccaagtgcggtggctcacgcctgtaatcccagcactttgagagtctgagacgggtgatcacctgaggtcaggagtttgaaaccagccaggccaacatggtgaaacctcgtctttactaataacacaaaaattagccgggcgtagtggcgcatgcctctaatccaagctacttggtagactgaggccggataattgcttgaacctgggagggagaggttgcagtgagccgagatcatgccactgcactccagcctgggcgacagagcgagactccgtctgaaaaaaaaaaaatttagactactttttatggacatttaactaagttagtattttggagtaaatggttattatcgttttcctcattggaaattgcatatgcgactggtgctagccaaccgctggactccttttctagttcacttatatatgagaccacaaatgctgctgaggcctgtttattcatggtacagtttctactatttctaggactgtttggcttacaaattatgttagtaatttgtggcttatgcagataaaaacaatacatatctatactatatgaacagaaatatacttaacaaaaacccacaaatatctatctatagttatatataaacactttcctacttatgtaagtaaataaatttacatgtacataatattcactcttctttgatattactattataattttgtacattttatttacattaacttttttcttatgtacatcatgtccctttagaagcataatttatttcatttcatgatctttattactacaaatgatcacaacttgaaaaatgggagctcctttaagctgactgtttttctttcagcagtgcctctgccatttaaaaaacaaatcactcttgtttcctggcaagaacaaaatgttacagacctattctgattttattctgcccaataacgtgaaactgactatcctctaatggtttctggttctttttttaaaaatagaacaatattagagacaaaaatctggtcactagggatgtttacaagtgtcaagtggggaaagactacagctactgctgctgccttgggacttctcttgctagcgactgagcttaaagaaaatacgtcttttataagtgtgtaaaatcttgttctttccagtatagcttatcatatcgttatcccttacttttcttattgtatgagatttcagcaattactaagagtttcttcctctacattgatccactgtgtcacccagtggcacagtagcccactttcctcccacctcctctctcactccgttttctaggacaatggttctcagcctagtcttcatactggattagcttggggagctttaaaaatgttgatatgggtctcactatcatagcttctgatttaaccttccaaaaagcagaatatggcatcaggattttgtaaaagctccataggtgatactaatgtgcagccaaagtaaagaacctctgttctagaaaagtgttgcaacctgaataaagccaaccaggcatactcccatgaaattacaccacagaggttccagggataccagcttgacattataaacagaaaaattaaatgcatgcttatcttttgactgctttgcttcaggagttttggggatggggacttgctaaagagagaaaaacacacctgcctttttttcagtcttcttgaaagactcatgtgtacaggtcgttgacttctccaattgttctgctagcatttctgtctttcagtctcatcttcctcactccttcctaaccttgctctaattacttcaaggttttaaaaggccttgatttcttcatctttgaggttaagataatgtctgcatgtgacacacactaaatctagcaaaattcaacaacatactgtaaagttcgagaaaaccataacaggttggcagcctaaggtcctagctgcctaaaatgatttgagaggctataatagaagtcaaatctgcttttctggctatgagattccagaaggtcaactgcagtgttaatccagactttttttatttgtctgtacacactttagggagtgctacatgtttaaagaagtctgaagtatgacctctaggattaaacacccctctgcccccaccctctccttctctctctctctttcttggggttttagacatcataaaattaaccaattcatctgatatagggaattgatagttgattataattatataccttattgacatatctacctccacttaagttacttttccatgacagaagcttgcattcttatagtatgaaaaacagaatgtctgttttagtaagaggacaaaggcctaggacctactctatttctgtgtaatctattagtattagttcttcacttagttccgatacacacccaagtctgggaaccattgtcttagggcatcaaataagtaagggtagttgcttctctaacgagaagggccttaacagaaggtggtgaactattctttgctcagaggagtttagctgcctttttccctcaattccctccctgccaaggatattatagacagagtcttctgtttttgtgggctgccatctcagaagctttgtctagtcttgatatattgcctggttaggattttaagaaaataatagatgatgctttcaaaaatatggcagtctcaattccctctttcttaggagtctcaaactttaatatgcaaatgaatcacctggaaaccttgttaaaatgcagattctgcttcagtaaatctgggtggggcctgaaattctgaagatctaatatgctctcagatgatgctgatgttgctactctgaggggcaaggtgctagctttggttctcaactttggcagcacgttacaatatagtaagaatatttttaaaaataatgatccctaggtcccactcctagagattttgatttttctgatttaattgatagagaatatggcctgggcatcaagagtttaaaaaactctccaagttgccaggtgcggtggctcacgcctgtaatcccagcactttggggggccgaggtgggcggatcacctgaggtcaggagtttgagaccagcctggccaacatgacaaaaccctgtctctactaaaaatacaaaaattagctgggtgtggtggcgagcctgtaatcctagctacttgggaggctaaggtgagagaatcgattgtacctgggaggagggggttgcagtgagttgagatcacgccactgccctccagccagggagacagagcaagactccaactcaaaaaaaacaaacaaacattctccaagtgactttcatgtgcagcaaaatttgaaaaccccttgtcttagtccaccatcaaaagttaaccaatatcacatttttttaaaaatggctcttttattcacttctcatgctataaaatatagcgcgcttagatagttcaaagcagtggtttacaaatctctatccccactgaccctggtgtggagaagcttccatcagaagtggtagaataagaaaaataaggataagaattatatagtaaatttcataaagctcaaataattcatttcaaggattcttctttgaaattgtctttcacacctttttgatgttaaaatatcctttttaaattaaattaaggtagtaacattatacctgtttatttgcttttctcatgctcttaatttggtaaataaagagttgcaaatcttatgttgatctccacatatttttggaaatcttgctggttcatgaaatttgaaaatctgggagccatgggcatgataaatccattaaaaattagaaaaaatctgatctttaagtctagaaaaatattgttataggaatatagtttttaatctttgattctctaatccctggggccaagcagtccttgaattttgtaagcaccagagtttattgctttctgtgtcagttcaggtccactaagcagatttcaagaaggaattagacttgcaagagatttattgagggaaccaccaagaaacataaagagagaggcagcaggagtgggcaagagggccttcagacagggaggcaggtctgacccctgtgggaaagaaggatgcgtgggtagggagagagcctcagccagtagcgcagctctgagaaagtctcagccaggctggtggggagccccagagcacagactgtctatcagagaggtccctgtcacgcaggaatggcccagcgctattctccccactgtgttctgtcatcaggttggaacagcctggggagggtggccttggcaggaatgctgcagggcatccgaaggtgtagcagctagagtgtcagccaatggctctcctcacagcaagttctcttctgtagggcgatctgtgtgtgcacttccatggctgccacactgggacttgcaattccacagtgaaaatgtatcttttttctgttggatgatgtgaaagaaaattagccatatggcaggtcattaatgtttctccgtatatcttgcttttggtcttgtcccttttaaccaatggccatttattaattataactcatcattatgtctgctgggcccacaattatctccataaaaaatgtaaaatcgctggtcactggataagtcgtgggaggtagaacatctggcttatgtaatgaatacatgtttaatattaccttttaaacctgtaatgttggtaggttttcatgtagtaaaaattctatttattagtatttcttgttattatttctgatcttatattaaataaggcattattaagcataattatcttagattatctttttcttggtttgccacagtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggttggtttatttatttgtcttacaaaagagcaaaatcaaataattcctgacttgctttaagtgaaacagtttacttaaatcatggtattggtgttttattttcaaataccagcttgacaaagaattacagcttgtgtgtgcattttctggggaaaacaggacattgttaaaaacagactctaagatcgctctgcactcaaccctattcccaaacccttttagcccatatctcatcttatgttctgtcaatccctttgatttttcggtgccatatttaacacaatgaatgaatagagaacactggagcatacaaaatggacaagccatatgtgattctatagacatcaggtctgtggcttgggagtgaagactggtggagtgtgctttgaatattcaaaaaggttagttactaagtcactctggaagagggggacactttctatcattttaataaactggttatttaaagtagggttaagaatatgcagaatttatagaattggggctcaaatttagccattctagtcctcccaaattaggaacttgaataactttgaaagattcctcttgtttggtttgccacagccaatctacattatattgcccctggaaatcctaacagccatggtttctatgtctatggataactctgaggagacaagataaactggataggcccatcttcttccacatttgaataaactacacacatttaaatgtgaggttaagctcaaaataaaacactttggacatgaggatgagatccatgcagagaagatgatataattatgtcagataccaaagtggctgtctgtgggtgtggctttacatatacaccagataatttaatgcttccccctggggctttatcattactagattataaattcattgagggaaaatgagctgtcctattcatcataatgtcccctgcaggaccttgtgcaatgccttcatataggagacacttaaagtaggagctgaatgaataaatagcagcttgttaagagcatggaatctaaatcagatggatctggaattaaattctagcttagccaactagtagttctgtgatctccaaattgcttagcctttctcttttttaatctttttaaatatataaaatatatgaaacctacagacacttcaagaaaataaaacaaacattcatgtgttcacacagttttgtcaattcttaacatgatgttgatactttataattctttgctgtttttcaataaaacattaaagatagagttgaagcccaccatgtaactctgcctaatcttattttcttcctttccacaaatatgttattatcctgatgttagtatctttacacatatctatagccataaacaaccaacagtattattattattatttttgttattattattatttgagacagagtctcactctgtcacccagactggagtgcagtggcatgatctcaactcactgcaacctccgcctcccgggttcaagcgattcttgtgcctcagcctccggagtagctgggattacaagtgtgtgccacgcctggctaatttttgtgtttttagtagacatggggtttcatcatgttgaccaggctggtctcgaacttctgacctcaggtgatccgcccaccttggtctcccaaagtgctgggattacaggaatgagccactgcacctggccaactaacagtattattgagcatctttgtcaacttcgtataatgggaacatgctctgagccactatgctacactgttccaggtattctgtatttcccctttctcataccaaagaatttcagctccataaaagcagtgatttttgtctcctttgtttattgtatctccagggccaaggacagtgtctcagtgtctggatgttaatggtgctcatttgtatccaatgagtgaatacaactaagactcagatttgaaatgtatgaaactcttagtctctgttcaagttcatatggtgtcttggtttaagatattaagacattttaccacgtttttgggattgtacattcatattattgagttgctctgtgtaatgcaaaaaaattgggaattcattccttctaacaaggcactaatactgagattaagactatttattttaaccttagtaattgctacacataagcgaatttacgcctggatttcatctccttcatcccgtgccttttaggaacactatagctctctgaaaggtcttaccctcagctggatcggggatgggaacaatatcctgcactccatcatgatgagcgcagcgaaattcggaatgcaccttcaggcagctactccaaaggtagggaaactttttgccttgaaactaacccctctcttaaatcatcctcagatgcaattacccagtgacaaaaaaagctctcttccatttaagtatagcacaggtgaggccacagaatttaggttacgttaccagccctactattaaatagctatctggcctcttgagagtccaatttcccatctctacaataagagatagtcttggctgatgccttttattctatgagttagtgttaaaagcatgtctgaattattcctttgaataccctgctgtaggccattatgatgactggcattgtgcattaccaccacaaaggctgaagaaagcaataaaatccaggcagcatagaattctcaacccatgggaatgatactgtcatttttctaacactgcaatttggtagaaaaatgtgaatccaatgtgaggatcacagtgatggcatctacaccagcttagtatttcaaaactcaactctggggaccttttggcttagaaaatttgagccccacatggctatgaaaatgacccctgcatacttcctaccttgctgctctctcacagcatgtatggaatacatgacttctttcataggcccaatgtaaaccttttgatacacaagaaactggtaataattgttgcctctgaggagaggaactgggaggtttgaggatagaggtaggagggacactttattttgaccatacagtcatgtgtggcttcataacagggatatgttctgagaaatgggtccttcgatgactttgttgttgtgggaacatcataccgtgtacttacacaaacgtagatggtatatatttttatttatatatattctttcacatggaaaaataaatgttccagcaccattactaaatatcaaccttaggccaggcacaccaccacaggcacaccaccgtggggatttgtgtacaggtgatttattaaggaagtactgccaagggagatccctaagggattagggggagcaggacagggaaagggaagaatctaagcaaggatgccatttacagtgaccaaccatcctgatttgctcaagatcaagagatttctggggacatggggtttggggtgctaaaattgagagtccgggcaaaccaaggtgatttggtcaccctagtcccatgtcgtgcacagtcccacagaaagtagcttcagcctgatctcacaggtgagctctggagtgtaagttatgccctaaagttatcccagcattggtcaagggcagcagaagaggtggagtggtaaatcccctggcacttttgatgggaaaagcagcctggtagccagagagctgtcccctgaagacaaactgcacgcactaggtgttaaaaacactgaaactggggaagggagcagaagccatgaaaagggatcccccgggggcctctgagtagatcaccaacatcatctgctgcatccagccaaaacaaaactaaccaccaccaaatgcttcaccaggtgtttttatcttgctgtcttggattcttagggctgccataacaaattactacaaactacacagcttaaaacaatacaaatttactctttcacagttttggagactagaagtttgaaatcaaggtgttgacaggccacactccctcggaagcctctcagggaggatccttttttgcctcttcctgcttctggtagccccaggcattcccattttccctctgtgtctgtgtctctctgtacaaatccccctcttcttatagggacaccagacatattaaatttaggcccactctaatccagtatgaactcatcttaactaattacatctggaaagactctatttccacataaggtcacattctgagtttctgggtgggagtgaattttgaagaacactattcaaccaagtacacctgccatagaaaaaatgtactgcatgcagtggaagtcatcctattatagtaaatttgagggactcagagagatgacccttacaacagataattctcctcttttattcagcgtgaactgaaataagggtcagatccgatatgtgcttaaagcggcttttattcactttatgggaagggtgagtacactctctatacaaagctagtttgaagaaaggctctgtattaatgcaaactcttattgcatttggttcccacagatgaaacatacattaacaataattgctccctgctatgaagatcttttggaaggctttattctgttgaagaaatatatggtttaaacattttattgcatgccaaagatgttttattaacatcaaaggaaaaaattctaatattacagagtaattgcagtattgttcttaaggagaaactcatttaaatgataaagagtactaaaacctggttaaaccttggtgggagtaagagttttgcaaagtcttctggaaagtctgatagtgcaaaagtcattccatcaatttgtaagtcttcagttgttagtagacctgtttcctttaaagataaagctaggagatttattgtaaattttagaaacactgaaacgtttccaaggccatgattaatctatttccccattctttaaccaagaataacttacatgttcaagaaaaaataattttgtccatgattgtaaaattgctccataaactatcaatagtaatgattttaacattgttctaagtgaatacttagagtgaactgggtgtgttaatcaccttctttgtctggttttaaaatttatgtaaaggctagtgagtgatttagtattgaaagctgagatgtgagtaaagaattcctctctgtattctaagtcatgcctcagtgcatgcaaggttgggtgattttctaatttccagacctctctgttggttctctaagtacttattgattccttttctaagaattattgtacttagggagtataaaacctactctccaaagggaaggctaaattttcagggtaggaggcacctgggggaatatccaagtctcttcatttatgtttaccagtatggctgttcacaacattagttgctaaattagctagcctttattaattactttccccaaatctctataaacaaggctccagaattcatggctatatgagggtggtaaagctgctaaaatgtctgcaggcatcttcatcaacatctgagtagtttcttctttcaagaatgctttaatagaagaagaaactatggtagacaatcatgtgcaaataaacacaatttcacaaataaacctagacatgcctgtcacaggttgggtttcttgggaagcagactcagagtttagtgtgcaggacaggcaggatgcttattagcatgtgcccttgaaatcaacaactgtggaaaggaagggaaggaagcaggagtaagagggagaagctgagttgcgatgcagacccaacaacagccttggctgatcttatggaaagttctggatctgagatgtccattcatctgtctggagttgggcagaggagggtcaggttttcataccctcctgtcaatcagccattgaatgtgggttgccccaaaagggtgtgtgaccttgggtgcggctgctctctgcagcagaggcagtgcccaaagggggctgacagctgaaagccgtcttctggcagcactcccagcagctgggggaataagtcctttattcatgattattcctggagggggatctcgggagcataccacagcgttcaccacaatgcttcagtgaaaagtgataaaaatcaactcataatcaatgctaagaacttgggaaaatgagaaggatagaggaaggtgaggataattacagtgtttgaactgacaagacttccatatggagggtcttggaggtgaggctgggctagagttttgaggagctgacacattgtgatgaagaagcccaggaggggacaagagaggaggtgttcaagggtgaaaggctgtgatggcagaaaagggcaagatgtgtacagggatgacaataagattggctttcctgcagcaagatgttgagaagaattaaaagagacagaagcagaggatggaggtggggagccttgatgctcttaatcagctttgacttaagaaacaagtagtaaacatcagaggcttcagagaaaacagttcttgctgctgtgtacagaataggttggagagtgagggtagaggcagggaggctgcctgtgggaatctgggataccttggggagctttagctgttcccatgatgtctcctcacccagagtaggaactaggctgagcaagcgaggcacctagggtgcagaatttgtgcatgcatgaccctgagaatgtgtgtttctttacattttttctagcgcctccttaaatgttttgccctaggcacctcgcttgcctctccagagtctgactctgccctcaccaaaccatcccggacaaatatataatcttagcaaaaacaatgtatttgttctgtcaatgcctttcaaaacaagcaccctgccctcaaaaggcttgctggggaatgcaaaagaatgagaggtgtgtaatgggggagggggagctgttagtatttagctgggatggtcagggaaggtttttctgaggaggggacatttcaactgagacctgaaaaagttatccacatggaatgggtggaagaaagaatttcagacaagaaaggatagcatgtgcaaagatagacaaacatgcattcatttgcacacttctgaatataatcctcttaagccattatggaaaccggaagaggtgcttccaagagttagaaagcaccatgccttatgtttgcctttatgattaaagaagtcggagatagtgaaagctggggcaattggttgtctctttaaattccaaaaggcactattgagttttggaattctagatgtaaaaatcatattctactgaacatggtgggaccacatcttgaaaaagggaaggagacgcgatattgaaaagaaaataatatatatttaagaaaacatgtataataaaattacctaaataagatttaaattcttcctcctttagggttatgagccggatgctagtgtaaccaagttggcagagcagtatgccaaagaggtatgctctttacatgtaaagctattattgccttttactgtcccatgaagttatttaaccagcgtgtttatgtatgctagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaaggtacaaattgatgcctctctgaaggttcattaattccattcatgaaggccagaaccatctaatcacttattcactttagggggagcagactgtcctttcattccctataaaaggactcactgactgtatcccctagggacttctctccttccaaagattagctgtgtcctttggaaaggcatttttgtgctggatgaaggaatttgaaacccactgagaagagaggagcaggcttttccctctcacaagaatcgaggcattgcagtgttttactctttgtgtgtttagagaaattaggttacttctgatgcatgcagtttcttatgatttctcccctaagaaaagccccttaactatgctcctcaggctagtccttgcctctattttccaaggacctctaaatccagtttagttttgctaatgccctccagggcattcccaggggactcatctgtttggctgtcttccagtaagatctggaacaatgcttctcagtcttgagcaggtattagcatcaccagaggagttgttaatacacagctggctgggtcccacccccagggtttctgattcagtaggtcagggtgaaacctgagaatctgcatttctaccaagttcccaggtgatgcagtgctgctgcctccagggccacactttgagaagcaatgttctggaggaataccctgaaagccaaatgcacaggggttttgtcagcaaagcaacaaatctactttggtggagaaagggattaagcaagtacaattaatattatattgataaagtaatacataaatacaagttctttattgttatatataaaatagaacagaagtttgaaaaataaaaagtaaaaatgtctttctcccatctctttaacagagactattcctagaggtagcctctgtttaataatttgatgtgtctctttgcagaccttttctgtgcatttacatatgtatgcctcaatacacacataactattgatttttttgtaaatgatattttagacattacttatttatttattattattcttactttttccacttaacaaatcttagattttcttgctcactcatttagatattttttattctttttagttgctgcatagaattccaaaggataagtggaaccataatttacttaaaatgtttcctattgataaattaggctatttctgagaatgccgattacaaaaatgctgcaatgaacttgcttatccatatttctttgtgcaaatattactggagaataagatcctgaggagaggaattttggggtgaagtggtataaattttttaaaatatgagagtgctgctaaattgcttacccaaagaagattaaaaatgtatactgctgcagctgtatattatagttatttttccatatcctctccatgtttagcttttatttacatttttaatttttctaaatctggaggaaaaatggcacctcatctttgttaaaatttgcaattccttgattactaatgaagttaagcatctttttatgtttattgggcattgcccttttttctataaattgctattacattttttgcccattttctatttttttgccttttctattattggttataggagctctttatatattatggctaatcccttatcatgtggaatatattttcatggagatattttaaattatataaattgcttcatacttacacttgcttggccaatcttatatgtgttgctggtgctggaactgtaggattgaagaacagtcattttgttgatgtatggcatttataaatgttacttttttccatgtaattttgctggtattttagaaactcaaaatgtcctgaacctagagcttgggtgggaggtaaaacaaaattgtagtacaaaggcagtaattttgaggtaagaaagtatgaaggaatgtagttttgaatctgtatgtgaacaatagaaatatatagggaaatgtaactttcagcaattaactgttggagaaaattaaaactgctagtacatttgcattaagaatgaaaaatctaatgcatagtgcttataatcctgtttaattcacccctacctcattacctttatctaaattgttttaactagtgatggagtatgcttcaagtgctaaaaataataatttggagatcagctccaaatataatattatcacaccaaagcaactttttaaatatagtggactataattggtgacttttgctatcagccacatattacattagtagagttctttactgaaaggtctactgttccactaaatagaataacagaaaactgagttactggtgtaacttgaagtggtactctcttaaatttaaaaagaaaaaaaaaaaaaaaagacttgccagacacggtggctcatgcctgtaatcccagcactttgagaggcgaggcgggcggatcatttgaggtcaggagtttaaaaccagcctggccaatatggtgaaatcccgtctctactaaaaatacaaaaattcactgggcatggtggcacatgcctgtagtcccagctactcaggaagctgaggcaggagaattgcttgagctctggaggcggaggttgcagtcagccgagattttgccactgcactccagcctgggtgacagagcgagactctgtctcaaaaaaaaaaaaaaatttgaaagtaccatgtacatttctcctaggtgtcttgagataaaaccatcactctgctcctttgtctctccctttgcattgatgtctgactactggccatgtgtgtttttagatactgaagaaaacaaatatgactgccacatataatagtcaaaaagtggtcttatccccatctctttagactgctaaagttgctgcctctgactggacatttttacactgcttgcccagaaagccagaagaagtggatgatgaagtcttttattctcctcgatcactagtgttcccagaggcagaaaacagaaagtggacaatcatggtaagcaagaaacaaggaatggaggataagttctttgtgtggttccaacttggtcattcatgcctttggggaaataataagcaagtgagattatccaactacattacttgctcatgtaacatctatttttttccagaaactttataatacatcattagtgcttattagcatttatagtgtatttgcatggagtgagattaatctcctttcaaataaatccattttaaccaaaattcttaccacccttgatccgcctgagcaccagccaccagtttgccaaccattataagtcatataattcttattttagaatctctttgttcatgtttagagaagcccctaattcagttcctgtataaaatgggcattcaaaacatcttactttttcccttctctttttcctcattccatgccttactttatgactggactagatacttgttttcgttctttgagtttggccatagggatatatgtgtttttaggtatagaacatttccaaatttcatggcaaaacttatcttaaaaattaatggttcctttcagataaagccactagtttcatcttcatcactgtcattctaggaaatattaaccatatgtctactttacaatatcccaaatgtcacctgctctggaaaatagtactgacatgtctaacttagctccaccatttttttagcttttagtgacttaactggtctcaattactgtatcagccaggatcttacttgcaaacgggagtccactctaggtagataaatggaaagtaatgtattaagagacattaagcggctcccagaatcttttgggaaaggaagtgcagtgaataattcttggacaccatatagccagggacaacacaggcagaaaaattgcccaatgacactgtggttcttttgtagccagaacaccactgacacagcctggtacctgaggctcttgaaaccagatgtcagatactccattatagccaccacagctgaaatagatttctctacctgcatatgtagcagaagatccaatctctccgaagacggcttccactgcatgttgtttgcttctgcacccaagtctggagtagatgcagctgagtgggatgcctgtaccctagctgcaagggagtttgggaaaggcagtttttagctttcagcctctggagtagagaaaagcaagctggaaaggactagcttctaattatttatctaatctataaattggaataggtttattgtgaacattaaagtaatatgtgtaaagcttttagtatagtacataacacataacacatggtaaatattgttatcataattattaccctcattatcatcatcttcactattgatctgatacagaccctataaaataagcaggggttcaagctcaactatggctgcttggcagccaaccgtgactcccttttcaatagaagtttgtatattaggcctaaatttgtcatatctaataacagggatgattttttttcactgcatctttccagcttgccacctcaggacactaactttggccaaaatgtcaattgccttgttatctaggccagtacttctgaagccttaatgtgcatttaaattacctagggggtcttgttaaggtgcagatttgaattctgtaggtctaagatggagcttgagatttggcacatctattttttttttttgtttttttttgagatagagtctcgctctgttgcccaggctggagtgcagtggtgtgatctcggctcactgcaacctctgcctcccgggttcaagcaattttgctacctcagcctcacaagtagctgggattacaggcaggtgacaccatgcatagctaatttttgtatttttagtggcgggtaggggggtttcatcatgttgcccaggctggtctcgaactcctgacctcaaatgatccacccacctcagcctcgaaaagcactgggattacaggcgtgagccaccgtgccaggccggcacttctaataaggacccagttattgcaggtgccaccatcctgcagaccacattttgagtagcaaagatctagatgacaaagaaaatgtgagctctccaaccacatacctcaggaagagacacagcaaaacattttccttgagctctgtttttcatcagaagacaattgaagttacaaagatatatcaagtaaatccatcaaagtagatcctttgtagaaattcagtagggaaaactaaaaggaaactttccaaaacatcaattatggagatgctctgaacttcttatcttttaaagagcttattaaacaacgtctttaaaaccaatttacttgaaaaattaaatacgtaatgtattcacatggttgaaatatttatggtgaaatcttacatccacccatttttccatccatctagatcttaccgccatctccccattccccatacccctgagttacccactattattagaggaaaatattttaaagaaaccaagagacagaatcgtgttaaaatgaaagtagagagtctaaagtagaaagaatgctcacctgggagtgatgagacttgacttctgtaactggccttaatactagtcagctgtgccatcttagcgtctaagtattaactctctaggtcccagtgtcctctcccatgaaataagcagattgagccatagagatggcaaatgagttttaattcttagatccctaatctcatcaacaggctacaggaattctgttgagaaggattttgagcctgcctatggtgtgagacagaaagagtggcataactgattagcgtgccttacacggacgctagaaaggaggtggtgatacatgtgttgcgctctttatgtctctgagctagatgatttggaggtccctttgagttcagttcatttcagcagccatatagtgagcatctactctatgccaggtcctctgccaggcattggagattgaaaaaaagagaatagtatgcagccaccacacagcctgtacagttcatagaagcataacattttcaagtgggatgagaccttagagactatccacgctaaattcctattctataggcaaataaattattattattattttattattatttttattttttgagacagagtctcgctctgtcacccaggttggagtacaatggcacgatctcggctcactgcaacctccgcctcctgggttcaagtgattctcctgcctcagcctcccaagtagctgggattacaggtgcccgccactgtgcccggctaatttttgtatttttagtagaggcagggcttcaccatattggccaggctggtctcgaactcctgacctcaggagatccacctgcctcggcctcccaaagtgctgggattataggtgtgagccaccacagccggccgcaaataaattattcttatacagcttatttagaatggcctttaggttcagcactgccgtgatacatttttctaagatgttctaatacttgtcttcctccagactaccctatccaatacagtagccagtaggcacatatggctttttaaatttaaatctaagctaattaaaattttacaaaattgaagattcaggccaggcgcactggctcatgcctataatcccagcactttgggaggctgagacagggggattacttgaggtcaggagtttgagaccagcctggccaacatggtaaaactctgtctctactaaaaatacaaaaatattagcctggcatggtggcgcacatctgtaatcccagctactcaggaggctgaggcaggagaattgcttgaacctgggaggcagaggttgcagtgagccaagatcgtgccactgcactccagcctgggcgacagagcaagactccgtctcaaaacaaacaaacaagcaaacaaacaaaaaaagagaagattcagttcctcagttatactaaccaagttgttgaatgctcaatagccacatgtggctggtggctacactattggtattggacagcacagacatcgaacacttccatcactgccgagagctctattggacagcactactctagggaataatttccacgcatgcaacttgatttaaaatgaggatgaaataagaaaggaaagccacaatgtcgccctccagttctgagatgcctgtaatgactgatgtaaggtatacactaaaataggatgaagggctttttctttaatggtgtagcattttttaaagcagaagtgtcctctttcagcactcagagtagctttttaaggcctccatgctaagagatttccagtagtgctgttcagaacgcttcactaatcgcatcattctcttcatagtgcacaggtctttggacccctttgtttagaaacaaaaatcacacttttcctccccatgaagcttgcttttgtatttttcagtgattaataaggcagtaggactcacaaaaagtagatagatgttttccctctgcctataaattttacactggagctaaaataacctaaagggaccctgaaaaaaagaaaaaatgctgacacttcaaagcactgttatccacatatgactcttaagtccaaaacaccattgcaaatgtaattcacaatattttatagtcatttacttctccccaagttagagttgccagataaaatagaggacacccagttaaatttgaattttggataaacaatgaataatttttagtctaagtatgtctcatgtactatttagaacatacagtaaaatatatatttgttgttatctgaaattcttatttaactgtttgtccgtgtttatttaactgaatctgacaatcctaatccaagttgaatttgtaagtttttatttggaaataaggttgacacaatccatagacaattaaaaacaaagcaaaaatgagaggggctcccaggaacccattaagaagtttacagtgtcttttacctggtagacattcttatgccaaagtttgccctggctaaactagttccttcttgtcattcagacatcaccttaaatgttactgttgagcaagatcttcccacaccacccactcttaagtggttcccaaggctcctttatctcctttttacattttattttctaatggcactacttgatatttttatatttttttgtctgtttgttgcctgtccccctactataatgaaaacttctttatgaaggcagtaaacctgtctgtaacgttctttattatacctagaagtttgcctgacacatactttaaatatggactcaatacatttttgcagcctaaaggcaatatagggaattggttttagaacataagttttggaaatcaggttaaaattctggctctctctgtgatcttgggctcctaatcaacttaggcaagtaccttaacttcactaagaccagtttattcatatgaaaaatgaggataaaaaatagaaccaacctcttaaggttatgaggattcaatgagatcagagtcatgtgagcattgtagtcaggacccagggacaggtaggtgcagatccacctctcaccatcaccactcaggaaacttcctacatctcagtttctcgatctgtattttacatctcttaccatctcatacagtaggaaaggatattaaatggtatgatgtacatacagcactcagcaccgggcctggcatgtgataactttgataagtatattcagttaacacttttgaaatataagacctgcacttttgatataggctaggaacacatgtacagtgtggttgaagtgtaagaacaaggacctgagagaccacaaaactaccttttaagagtagagtcatccagattcacccatgttgtcacaaatgacaggatttccttttttaaggctgaatactattccattggatatatacaccacattttctctatccattcatccattgatggacacttaggttgattccatatcttagctattgtaaataatgctgcagtgaacatggaagtgcagatatccctgcaccagattggtttcagttcctttggatacatactaggaaatgggactgctggatcatatgggagttctagttttagttttttgaggaatctctatatcattttttataaaggctgtactaatttagattcccaccaacaatgcacaggagatccccccctctctgcattcctgtcaacacttatctttcatttttttaaaaataaaagccactctaataggtgtgtggtgatatctcattgtggtttaatttgcattgccctaatgattaatgatactcagcattttttcatgaacttgatgatttgtatgtcttctttggaaaaatgcctgttcaggtcctttgcccattttttaatcaggttgttttctttctctttagttgtttgagttccttatatattttggatattaatcccttaacagatgtatggtttacaaatattttgtcccattctgtggattgtctcttcactttattaattgtttcttttgctgtgcagaagctttgatgcaatttgatttgtctatgtttgtttctatcacttgtgttttcagggtcatatgtgaacaattacaagactcatgtcatagagcttgatatggtttggctgtgtccccacccaaatctcatattggattgtagctcccataattcccacatgttgtgggagggactggtgggagataattgaatcacaggggcagtttcccccatactgttcttatggtactgaataagtctcacgagatctgatggttttataagggaaaagccctgttgcttggttctcattctctctcttgcctgccaccatgtgaggcatgccttttgccttgtgcaatgattgtgaggcctccctagccattggaactgtgagtccattaaacctctttttctttataaatttcccagtctcgggtatgtctttatcagcagcgtgaaaaaggactaagacagagctttttccctatgttttcttttagtagtgttacagcttcagagcttatatttaagtctttaatccattttgagttgatttttatatggtgtgagacaagggtccaattttatttttctgcatgtggatatccagttttctcaacaccatttgctgaagagactgtcctttccccattatgtgttcttggcacctctgtcaaaaagcaattgaccataaatgcatgggttcatttctgggctttccttactgttttgttggttaatgtgtctgtttttatgacagtaccgtgtggtttttattaaaatgtctttataatatgttttaaaatcaaggagtgtgatgctgccagctttcttccttttgttcaagattgctttatctatgtgggttctttgtggttccctacaaacttaaggattgtatttttgatttatgtgaaaaatgacattggaattttgataggggttgcattgaatctgtagatcactttgggtggtgtggacatttttacattaattctttcaatccatgaacatgggatatcattccatttatttgtgtcttctttattttctttcatcagtgttttatagttttcagtaaacaggtcttttaccttcttgatacaatttatacctaagtaattttttgttgctgttgcaaatgtgattattttcttaattttcttttcagatagttcattattagtatattagaaatgttactgatttatgtatgtcgatttcattttctgcaattttactgaattcccttaccagttctaacagttttttggtggacattatgctaagtaaaataacccaggcacagaaagacaaatactacatgatctcacttatatgtggactctaaaaaagttgaactcatagaagtagagagtagaatgatgattaccagaggatgggggatgggaaggaaggcaatggggagttgttgatcaaagggtacaaagtttcaggtagacagggagaataggttttgagatctattatacagcagaatgattatagtcaataataatatatatctcaaaataacttagagaagaaatgtcaaatgtctctccataaaaaagataggtaagtaaggtgatggatatgttcattagcttgatttaatcattgcacattgtatacatatatcaaaacatcatgctgtactccataaatgtatacaattataatttatcaatcaaaaataataatttttaaaaagagtagagtcagagaaaaccagggttccaacccagttctgcactatctgtcatctcaaggattgatttcctcaactataaatgataataataaaagctaccttagaattttgttgtattaaatgagataatgcatgaacattttcctctagctcaccaaagctcctggcacagtgcttgaaaaatatttcttgaccaatacatgatatggtacttagtattctatctaatacctagtaagcactcagttaacattcaccatagtttctgatattattattgtcattcttgtggagattgagaaaagtaaaagtgaaaattaccatttgtgattgacagatcaaggggaagcggtatactcttggctatagagataatactctttcaggaatacccagcttcagagagcagacattgctcagattactctacatctgattcatcctaaacttctctaggctgcgagagatcaaaccacggtataaacacaaggatctggaataggagagatgatatttctctaaaactagccaatactatacttatgactggaaaattcagtcgtggctaccactgtagcatctcatttcaactctgtgacccactagtcctggaatgaggcctaattatgcagtgtttgtgtgtctagatcagtctgatctctgttgactttcatttataccctcctccaataaataaataaatattagttcagaactgttctcttaccattttcttgagaaaacacattttaactgtaaccctgcaaagctgaaacctaattcaccttctctaggtccctaagcagactgtcgctaatgtttatccatttctttctttctttgttgtgtcatcaggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttcaacataaaatactgtgttcataatgtataatgtctaagccattaagtgtaatctatgcttattacctaaataaattatcacccatgctaattta

SEQ ID NO: 3326 - DNA, 1338345 bp, human; identical to SEQ ID NO: 3315

SEQ ID NO: 3327 - DNA, 112722 bp, human
gtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagact

SEQ ID NO: 3328 - DNA, 59095 bp, human
aaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgt

SEQ ID NO: 3329 - DNA, 105134 bp, human
tatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccagg

SEQ ID NO: 3330 - DNA, 126627 bp, human
tagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagc

SEQ ID NO: 3331 - DNA, 126728 bp, human
gtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgact

SEQ ID NO: 3332 - DNA, 127544 bp, human
taggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattac

SEQ ID NO: 3333 - DNA, 126627 bp, human; identical to SEQ ID NO: 3330

SEQ ID NO: 3334 - DNA, 126854 bp, human
gtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttt

SEQ ID NO: 3335 - DNA, 126728 bp, human; identical to SEQ ID NO: 3331

SEQ ID NO: 3336 - DNA, 1338345 bp, human; identical to SEQ ID NO: 3315

SEQ ID NO: 3337 - DNA, 112722 bp, human; identical to SEQ ID NO: 3327

SEQ ID NO: 3338 - DNA, 59095 bp, human; identical to SEQ ID NO: 3328

SEQ ID NO: 3339 - DNA, 105134 bp, human; identical to SEQ ID NO: 3329

SEQ ID NO: 3340 - DNA, 126627 bp, human; identical to SEQ ID NO: 3330

SEQ ID NO: 3341 - DNA, 126728 bp, human; identical to SEQ ID NO: 3331

SEQ ID NO: 3342 - DNA, 127544 bp, human; identical to SEQ ID NO: 3332

SEQ ID NO: 3343 - DNA, 126627 bp, human; identical to SEQ ID NO: 3330

SEQ ID NO: 3344 - DNA, 126854 bp, human; identical to SEQ ID NO: 3334

SEQ ID NO: 3345 - DNA, 126728 bp, human; identical to SEQ ID NO: 3331

SEQ ID NO: 3346 - DNA, 1338345 bp, human; identical to SEQ ID NO: 3315

SEQ ID NO: 3347 - DNA, 126627 bp, human; identical to SEQ ID NO: 3330

SEQ ID NO: 3348 - DNA, 126728 bp, human; identical to SEQ ID NO: 3331

SEQ ID NO: 3349 - DNA, 127544 bp, human; identical to SEQ ID NO: 3332

SEQ ID NO: 3350 - DNA, 126627 bp, human; identical to SEQ ID NO: 3330

SEQ ID NO: 3351 - DNA, 126854 bp, human; identical to SEQ ID NO: 3334

SEQ ID NO: 3352 - DNA, 22819 bp, human
cacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattacaa

SEQ ID NO: 3353 - DNA, 126728 bp, human; identical to SEQ ID NO: 3331

SEQ ID NO: 3354 - DNA, 1338345 bp, human; identical to SEQ ID NO: 3315

SEQ ID NO: 3355 - DNA, 3298 bp, human
cactggggccatggcggcgcaggaccgggcttggcgcaacggcacacgatgcggtcctcgagcctcccgggcgctcggtcaccgcgccgaaacgggagcgggcagagtcgccaccgcctaccgccgggccgcctcagaacaggaagccgtgcgccgaccgcggaagcccgcccccatgtagcgagaagtccgccgaccccagggacaggagcgaggggcggggggaggcggggatgggggggaagcagggcggccccgcagaggggaagctgcgcctccgcaaacgctcagaagcagcttcgccagacagccgcaacgtacatgttgactgcccgaggcggaagtcgatcggcagagcggaagggggacctgcagaggaccttccgacaggtctgtgtctgttctctcagctgtctagcaccgcagcgctggggggcgcgtgggagtgaggcggtacctgtgagcgcgcgggagagcggaaaagggagccgcgcgccgccggaaaccagggtgagggctgagccggagtcgtcaccgggaacgtcagcagttgccccgcccttaccctcgccgctctccctcccgcctccgccccctggcgttgtaaaggcgacaatttgcccagagaaatccaccatcgcttcctaagtggggcacaaacacagccaggggaggcctcctctaaatgttcgtgaattctggttctggaatcgcgaagaaatgggagcggccgcgcgcttgtgattctcaggcctttgctcctcccatacacgtccacggcgcgttacgtgggagaacgttttcgcccctttttttttttttccaaactgtgggaaaaggtgctagaaaatatgattgcgggtagagacagggccgctggcagagtaactcaattttaatagagtcgggtgtatgctgaggtcgtcaccatcccccaaatcctgtcagtcccacacaaaaacggcccttaaatcccctgccacgggctctcatatagtttttgtccttgctcttgcagtcaccgctctattctgaagggcttttcagttcatccatgcctaccgacactcccgtcccccccatcaaagtccacgtttaattttttgtacctgctttaaaacagcgattctcaaccttggctgcactttgcaattatctgaggagctgttttttaaaaaaatacttagatatatgggttccacccctgtagattcagatttaattggtctggcttgaggtctgggcttggggaatttttgaactttcctaaggtgattctaacatgccctaacgtagagattcactattagaagcattcgttgctgcgacccctttcaaacatctttttgcagtttcatctcctcttggtgtaagagatgttcatgatgttccctaaggttagaatattcttactgtcatcacttgggtaattctttatcattgttgaaagcggttcatctgcttctgaaggtgtaagctcacttgttccctcccttggtggtcctaaagcacattgaaacagaatatcattgtgctagttattaaaatgcattgggattatttataccccttacagatacagttgctggaaggcagctaccttatttttaaatattatttttatttttaattgatagtatatacttatggcatacaatgtgatgttttgaaacatgtaaccattgtggaatgagcaaatcaggctattaacatctatcaaatgatatacatacttacttcttttggtgagaacatttaaaatccacttttagcaactttggaagatacaaaaggttattgctaattgtagtcacattgctgtgcaatagatcaccagaacttattccgcctatctaactgaaactttgtaccctttgactaatatttcccctttctccacccactgtcctacccggcctctggtggtaaccaccattctactctttactttttttttttttttttttttttgagacagagtctcgctctgtcgcccaggctggaatgcagtgacgcgatcttggctcactacaacctcgcgtcccaagttcaagcgattctcctgcctcagcctcctgagtagctgggattacaggcacgtgccaccacgcccagctaattttttttaaatttttatatttttagtagagatggggtttcgccatgttggccaggctggtctcaaactcctgacctcaggtgatccacccaccttggcctcccaaagtgctgggattacaggcatgagccaccatgcccggcctgaatttcattcttttttaaggctgaatagtattctgttgtatatttataccacattttttaattcattcattggttgatggacactttgattccgcatcttagctattatgaataatggtgcaatgaacatgggagtgcagatatctcttcaacatactgatttcagttcctttggatatatacccagaagtaagattgctgcatcctgtagtaattctatttttagtttcttaaggaacctccatactgttttccaaaatgggtgtactacaaatttacattcacatcaatagtgtacaagggttcctttttctccacaccttcaccaacacttgttatctttcatctttttgattatagacattctaacaaaatttgtttgctccctacacaaattaattgtgtggttttaatttgcatagagaggcaggcaaaggctactctgctaatggctttagaggccacagtaagaagtttgggttttattctaaatgcaaagccattacaatgttctcatttttttctaggttggtcagaccatgcccatggttcctcctctcgacttcactatgaatgccgcatctgttgaatgaatgcagtttctgctcttgcttttggatagaagtgattgcaaatcttatcaaaataatgaaaaaaattacttttcaattccttttcaacccttttgagtctgaggggcagctgtacattaaatgaaaccatatgtatcataatttcatttttccatcaaaagagctttaaaggaaattcccctttttctccatgttttcaatattttttgttccttttgttaaaatcagattaatctcatgaaacatctgaagcatttaagtcaatttaagagctgagaaaatatcatgctgctagttctgaaacgatctgaagtgtgaatcaggtgatcaccaaataggggaacaactgaaaaatgtgaatgaaagaagtatgtacctatactatagtgtcaaatattgtactgtaagctttaaaatgataaattggaaactttccaaaa

SEQ ID NO: 3356 - DNA, 31074 bp, human
tttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcaggtgagccgcaagaaccccaccgggctggctgctgcgtgaattcctcccctgacctaacctggctaatggcgcagcgctaaccggcacccttacttttcattttctgggtgccccgggctggcgggtgtgagtgccccggggctatagagggataggaatgttggttggggctgtcgcccgggcccggtctcggcccgctgtattgtccccgggacgagcacaatggcggcttttgtgtgtgcgtgcgcaggcgggcggagggggaggaagtgcgcgcgctctcgcggggacgcgcatgcgcgaatcccgactgattagtgacctgggggggtttgcgggagtgcgcagcgcggcgggacgcgactggaggcccttttggcttggagggcttcggccttcacggctggcgcagcctggattcccgtccggaggacctggcggcacccggtgtttgcgtgcctgcgagcaaggggtagaacgcggcccaggaatgtgggagggggcggccttcgctcggggtaatggcggcggcctcttttgtgtggtgctgggcggcgctgtggctcacctccgggagacggcgggtctcgggcgggcgaaggcctggaaaggaggatggaatgggtttcttgttttttcccgggttccttccgctggctttttcgcttcagcccaggttccgcagggtccgggggccctgcgccgcagccggggaggctgcgtttccggagtggaaagttttgtgacgcagaagattggggaggagtgggggaggggtgggggcggggaggggaggcaggaattggccgctgcgcgctgggccctggagatagaggttggacgtggcggggaggttagggagccagcgaggccctttctcctccttgcttgccccagattgtccctgtgtggtatgttagccgggagtcccgcgttgtttttctggggtggaggggtcatcgcgggttgtggtagtgtcttcgtgttagtgactgtgatccaggaatccgccattggaaaaacacccggcttaggggggaagtaaacagttttgttgttgacttgttgctatctgtggagtagaatcttgcaatgggtcccaggcccccgggttttttctcttagccagaatcccctcttctaagggtttaggggcagaggagagaaagatgtgtgatttgagaggagaaggttatggactttggtggcaggaagtctgcatcccaccgcaacagtggcaccaggcttcagataagctcttgtgtgggttatgcggagcttttaaataaactactgtctactgtgattaggggagcgttgatttcacaaactccggaataatcctgagacgaagtttagtggcacaaattaattgaatacatagtttaatgtagtcatatgtaatattttttaggaattgatctgttcctttggaagcattttctacccgttaatgaaccaattatattaaatcctctaattgctgacacatgttgaattgaacagacactttaacaacctaccagcagcacagagtattcccagttttaccattttccatttagctatagtgtccttttaaggattctaggcaacagtgaaccttatttaaaaagcaaaattgtgctataacaagtgcaaaaggaaagtttgtgttcctaccgtgctttaaagtattgatggtagcaagagaaagcgcagtggtgtttttgctcatagaaattctggaaattaggtgcctgaagtcttacactcattttttaaaagtatagcatctgcttccagttttcagtgactccattgatgatgcatgcggtttggccgtatcatactgagctttaaacacaagatttataaacatggtatgtagtgcatcttttgcaaacaggttggcagcggtactgtgtgacttggtcttttgtggcttttttgagaaaaatgaaacactttgcatgtatagttttttctcccaactacttgtgagtagttcctggttataaaacgttatgaaggtagcacataacccttttctagaatgaagaggcttttgagctaccagtgtaaggggataggtagaaatagagatgaaaggcactaagatgtcctactctttaagagcattgaacgccagttgtgccatttattcaaagtcatctttgaacttatgttaaaatggggtaaaaacaggtaactacttcaggccgggctcatgcttgtaatcccagtgctttgggaggccaaggcaggtggttcacctgacctgaggtcaggagaccagcctgggcaacatggcgaaaccccatctctactaaaagtacaaaaagtagcctagcgtggtggcgcacccctgtaatcccagctactcggggaggtggaggttgcagtgagccgagatcacatgactgaattccagcctggatgacagagggagactctgtctcaaaaaaaataaaaataaaaacaaacgaaacagtcaaactacttaagagttgtgcttaacatagtgttctgtaagtggtaggtatattgctatttttttgttgttcttaagagtactacccgactaaaaatacttgggcaatatttagggatgaagtatctaactaaaagaacggccacttcgaaatttgtcctgacatttttcaggtgtgcattttaggtttaaaatatcaagtattacggaaagttggcattggaaactttcataaccggcactaaaacgaatcctttatctatttgacattgaggaataattttgagattcagtgtaagctttagtttggtgattagggagcctgtgctatggaacatgttagtgaaaatttattttgaatgcatgaattaaatttggacagtttctactgaacagcacaagcatcttggtgtgccgccttctgtagtatatacaatagtaatattgcatttgcttagagcattgcagacttgaaaacattcttagtcacattctcattaagggttggtattagccctgtgaggtggactgggcaactacttgaatgcagtactagcaaatgctagagggcaggactagttttctcttaatgtagtatttgagcacatggggtgctaaccatctcactctcttctagtttgctggcctagacctgaactcttcagataatcagagtggaggaagtacagccagcagtaagtacaacatcttgtgggtttattgaatattagagcttaacatcttaagatttcattgggcttatgtaaaatttaagaaatttgcctttcaattttttactgcttaaagaattatgtagtctttgtgttatagaattatgtagtacttagtgatcaatctaaagcatcgttgccttttttttttttttttggttgagatggagctttgctcttgttgcccaggttggagtgcaatggtgtgatctcggctcaccgcagtctctgcctccgggttcaagcgattctcctgcctcagcctcccgaatagctgtgcctttctgataataaaacatcaatgactagctggctctcttgagtaaaagcagctaatcattggaaagaaccttattatatcaaattatctctagaagagtttttgtccattataaatcctgagcccagtttagaggtgatgggaatgtgtccctgttaactgactatatttattaaattgaattaagggaatatgcatttcattggttatagctactcctttctcctgaagaacagaagactatactgaattttggattggtggttaggttaggttttcaaatgtgtcatttcttttaaaaaggcattagaaaagttgctttttttcttctaaggggggttatttagagacttgttagaggttagtgttaagataggggatcttggtggtttattataagggcaatagacccttatttttagctcagatctcttcctacttattaaaacaaaagtgagtatgggctatgatgtgtcctcatttttaggcaagaacagcttcactgggaacaaaacttggtgtttgctttaactttcaccttatttgtcatgctaagaatcttttaggaactgattgtcctagtagagatttttaaaaatatttaattcagtctagaagtgaaaaagaaaaatgacacgtttactagttataaagcaaatttatttggctttatgttgttttttttgcttatccatattctaggctgtactcctgctcgcatacagagcaactgtcaactttccttaaactcagcaagccccaaattaaaacctgcaattccttgaaattaactcccctttgcagcttttccttgtttatttattgtatgttttgcaacttactggcatagaaacaaaagattgtgagatatgttacatgagtaatcttaaattgttacagtaatacttaatgcttttgttgacagttttgatgacagttctcttaaatctagcaggcctttaaaaaaatcacattaaatgaccactggtggctaaatgtgctcaatttgtggatttcaactattaggttccaaatcagcttttttttatcaaactcctttcagagttctccttatgaagcagtaacccatttaaaattagattcttatttttcccccctctcagtgtccaggtaagtaatcagattggaaggctggagattttaatttcccagaaccattttttagtaacagaaatttaaatgggaaggttttttggcatttaattaattttatatatatatatatttttttagaagggcgctatattcctcctcatttaaggaaccgagaagctactaaaggtaggtcctcacaagtaacttcgtaggtctattttttgcctcctttagaagttagtaaagcctaaggaaaaccaggcatttgggggaggtctaaacatggtgttgtttttctatgcttctgtcagccttggttcaaatactagagcttaataattttggaagaactcatctaatgttacgcagtgggaaattcggcattcctatgtcaaactgttctgacgccaagggcatggttttgtacagtttcactagtgttgtgctgaatctgtttgtaatcattcacagcatggttttagtttggaagaggtgggtgccctactgtgtaaaccaagctgtataatgataacaacctggttatttctgtcttggcaaagttgctagaaatgaagatgggcttattgtagaacagttaacaagttacagcgttggaagtgattctctggtttcatctccttgccttgctgcttttgaaaggttttgtccaaaatgtattacaatatctggtgtcttttcccattgtaattgtaacgtagtgatagatgacagctagtatatgtttcatattatgagacagctgttcgggtgctttatattctgtaaaatagaccatccaaaatttggaggaaaagggaaagtcaggaaaaccaaagattaggagggaagatactgtataaagaaggcagataggaagagtggagagtccacaggggagcacatggtttgctgctgttcctccatctccatatgtagtctgtattaccttcactgtcctggcaatgcatggatataaaatctgtattatttctaccagaagatcactttggctttttttttttttttttttttttgagacggagccttgctctgctgcggaggctggagtgcagtagcgcgggctcactgcaacctccgcctcctgggttcaagtgattctcctgcctcagcctcccaagtagctgggatcacaggcatgtgccaccatgcccggctaatttttgtatatttagtagagacggggttttgccttgttgcctaggctggtctcgaactcctgacctcaagtgatccacccgcctcagcctcccaaagtgctgggattacaggcgtgagccaccatgcctggctggcattatattctttttaggggaggttactttggaatttgtctttatcatcatggatgttctcaatattcctagtatactagctagaattgaccctcgtgtatatggcagtatcatagaggttttagagctggtagagatctggcaatctaacttaactctttcttgctagcaaaggctgttggtcacctgactggcctaacggtaggaggtagaaggcagaaggaaagtaactgaattgagaagctgtttctgtttaataaggtgttgctgaagctagttaaaccctctacctgtctttaaaccctctacctgtctttgggttaatttacatgtttgtcatccccttacctggatatttatagctgtacccaggaaccttgtctatactgagaatatatagtgatgagggtttttctttttcccaggtattcctgattgtcatcaagcttatagtagatgaaccactaaaataatactacaatttgacattagtgttcttgtactttatactattgaaactgaaaaatactgtattaaaccaagtaatctgacagtctatgaatgttctaaatgaataccacctccaagaaacatggaaacaatggtaactgtttttcctagtaaactcattcacacctataaaatgaatggaaattaaattgttatggtcacacaacgtcataatgcgttacaggcaaagctgttgaccacttagaggtagtattcattgagaaacattcttagactgtcagattgcttgatttagtgtaaagtaatttttttttttttgagacaagggtgtttcactcttgtttcccgtgctggagtgcagtggcgcaatcttggctcactgcaacctcagcctcccgggttcaagtgattctcctgcctcagcctcctgagtagctgggattacagacgtgggccaccacgcctggctaatattgtatatgtagtagagacggggtttctccatgttggtcaggctagtctcgaactcctgacctcaggtgacctgcccgccttggcctcccaaagtgctgggattacaggcgtgagccaccatgcctggccagtggacagtattttctagtggggagaattaaagaaaaactttgtccgggtgtaaaccagctttaaatcttggttctcttacagtgccatggtagggatagtcagtggaggctttcaaattcagaaagattgataataccttaacatggttcctatttctaattaataataaaatgtatttgtgcttttttaatcaaaggtttctacgataaagacagttcagggtggagttctagcaaagataaggatgcgtatagcagttttggatctcgtagtgattcaagagggaagtctagcttcttcagtgatcgtggaagtggatcaaggggaaggtaagtgatttcttaatcaccttacgtgtatgtataataacagtttaataagtcgttatcctgaccacctgtttggatgttaagcattatgtctgtttggtcattgtattttcttagccgtaagaggcttttactaaattgaacctgttacttagaaattagatgaaaataggaatatgctcattggcataatgaaatgagttattctatttctcgagttttatatgttctacttaaaagagtaagttcatctagtgaatggcctaatttggttgggatttttgtggactctataacaatttctaaacaccttgtatttttgattacacaagtgtggtgaactgaccccacgtgcctaatagctgtggttagtcctgtgtcctgatttttcgcaaacaggcctaaaactcttaaaaacatcttagttcaggtaaggattattttctaccttttatccaaagtctgtcacacaggtgaattgtcctttaagtgacatcctagtataactaggacgattgatatttggtgtgctattttcttgttttccctaccattaaatatatttggatgagcactttaaatgaaggttgtgagctgtgtgccgatttcaaataaaatccttattcttaattttggcatctgtgaggccttttaggctatacaactttatagaaatgtaaagattactgattttagaaaacgaggttatgtaaatgatgctggttagagagccttatttgtcaagtaactcagaattggattgttgacatccttatggttagccataacttaagtctccagatacagttctagagtagggataagaatctgataatggttaaatgatatgattctgattaattgcttgtgctgttcaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacagtaagtttttgaagtgtatgttacttgtgatgaagccttactagctagtataacaaatgaacttatccattttttgatttgagggaactcttttctggaggcaacactgggattaattttgagaaatacgatgacattccagttgaggcaacaggcaacaactgtcctccacatattgaaagtgtgagtatttttgcttgactttttaagacacagagaggttaaatgttttcatgttacattagaatgtgagatgggcttcataaagtcatgtagaccagaggcttcatagatttgtggaaaaggagaagttgagttcagtgtcaccattatgaataatttattacctaaaatagaaaatgggtcaaacataggaacaacccaaagtcttctccaatgtgcagtaagcctgggggttggtttttctcaaagtataatgtgataattttacttaaactataaactgagttaccaatcagctgttggttggttgtttccattattagtataaaacagaaatagctctagatagcattcctaaccccattgaatttcttaacagttcagtgatgttgagatgggagaaattatcatgggaaacattgagcttactcgttatactcgcccaactccagtgcaaaagcatgctattcctattatcaaagagaaaagagacttgatggcttgtgcccaaacaggtaagctcaactcataagagtaaaacatcatatttcttctgtaaaggactagacaataaaatattttattttttatgggtcatgcagttttgcagctgctctgcgctgctattggactgtgaaagaagccatagatgatacataaattattggttacggctgtattccgtaagagctttatttataaaaataacaggctttatttacaaaatagtctcagtttgctgactcctcttagaggtggagcagagaagccactttttggaaaacttaagcataaactaaaagtactaattattagtaatagggtagttaaaaaacactgtcatctaccaatgtctgtttaaaagtaatgagcaggatttgtttgtttgtttttgaacagggtctggaaaaactgcagcatttctgttgcccatcttgagtcagatttattcagatggtccaggcgaggctttgagggccatgaaggtagatgtttctttataaaatgggaaattgtagaactttgtaggtggccattgagagggctttctaaatgatgctaagacttaagtagaatgaaaaccagttttcaagtgtaatctgtaatctataaattacaaaagggaattatgttgtgatgaacttttcaaacagggtaggtagagttaacttaaaaattaacttatttcttaggaaaatggaaggtatgggcgccgcaaacaatacccaatctccttggtattagcaccaacgagagagttggcagtacagatctacgaggaagccagaaaagtaagtatgagttccagtgattattagctttttcattgattctaattaaatgttttatgaacatgtaaaaattttgaccttgaagttcataacattttttttgcttatagttttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaagtatgttttattttgtttttgtttttttgttttgttttgttttgttcttttgtttttggcagagttgcgctcttgttgcccaggctggagtgccatggcgcgatctcggctcaccacaacctctgcctcccgggttcaagcgattctcctgcctcagcctcccaggtagctgggattacaggcatgtgccaccacgctgggctaatttttgtatttttagtagaggcggggtttctccatgttggtcaggctggtctcgaactcctgacctcaggtgatccgcctgccttggcctcccaaagtgctgggattacaggtgtgagccatcgcacccggccaagtatgttaatttttaaatgtatgggatgcagtattaaagttactgcccattagttttgtggtgatgttaacattgtctaaatgttaaggctgagaagtgatgtatttcagacatctaactttcacaaaaagcttgttcatggtaattttaatgttgaaaaatcagtaacatcttggttgagacttacaacaatgatcagctcgtgggacagtcaactaggatgggctaatttgactgtgtaatcttgaatgacttatgtagtggcaagaatcctgtgctgtgtctgtaaaattatgcagtgtgaggcaccatcttaatgaatatataattgtaataacctatacaattgtatttgtaattatactaacagccatactaaaaccatgttgatttctcctcaaattctaaactcaggcttgttttttttcatgacatgacagatacttggtgttagatgaagctgatcggatgttggatatggggtttgagcctcagattcgtagaatagtcgaacaagatactatgcctccaaagggtgtccgccacactatgatgtttagtgctacttttcctaaggaaatacaggtactgtttgatgttgcaaattttatttatttagaaatttgtttatctcaggtaataataaaaattttttttctttcagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggtaacattatgaattttttattttattagacatgggggtttctctttgttgcccaggctggagtgcaggggttattcacaggtgtgatctcattactgatcagcatgggagtatttgacctgctctgtttctgacctgggcctgttcacccctccttaggcaacctggtgctcccttgcttccgggaggttaccatgttgatgccaaacttagtgtggacacctgataggcatagtacactacagcccagaactcctagacttagacaatcctcctgcctcagtctccagagtagctgggactacaggcactcaccactgcacccagctaaaattatgaataatttaattgctctggtaataacccatttgggctgggtgcagtggtacagtgcatgtagtcccagctacttggcaggctgaggctgtagtatgccatgattgcacctgcgaatggccagtgcactctcagcctgggcaatttagtgagacccccatctcttaaatgtatttggattacctttattacttttcctcctcaattcaaaacatgctgtgttgaaagcccgtttttaagaagatatatatgtattttaattgacacattaaaattgtgcatacataagtgcaaagagaactaagccatgttagtgacaaaaacctataatttttcaacgacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtatgtataaacatctttcttttattcaaattgagcatgttcaagtatttgttttcttttaagtgggccatatctcataaaagttattttccaggtagcagcaagaggactggacatttcaaatgtgaaacatgttatcaattttgacttgccaagtgatattgaagaatatgtacatcgtattggtcgtacgggacgtgtaggaaaccttggtaagtatttgattacttgatggtttcattgttttttgctgtgatgtgtgcaggaaagaacttgctaggatctaaaatacatttttaacaatgaaagtgacaaagattttgctcaaagcacttgtttaaatattacgtggtaatattttaaatatttctacgtaggaaagtaagaatagtagcaagttactttatggaagacctttgtttatatacttttttgggaactcttttaggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagaggtgaggtataaatagtatataatgaggggaatgggtgttcacttacagttcatagtgtttcctctgcatgcataacgtccaaggttaactgtacagtatttaaaaagcttaatcatcttaggcttcctagattctttggtaaggggttgtattagaatgggtgacactctgttggggaaaatatggctggatggggaattgtttgaatggaaaaattagaaattggtcattaggaaagagttaggttactttagtggaatttcatcttcatgtgaaccaacataatttttttcttatagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtagtgttaatctgtaacttcatagctttgggaagggtttttttccttttagtcatctttttcaaagcctaattaaacaatttaagttcagcactatagaaacttgatggcaaattacgtaagggaaggattgtatttaatgatggataacttcattaatttctctctctttttaaatctctcattaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaattgtaaaatgttattttttgcttgtcatccagtgctattttttgagatgcctcttggatacagaatgactcataccataagtatttgcaatgaaagatgaagatagtattagtttgaaatacagtgaaacaggatttttgtaatagacggaaatctaaaaggcccttactgataatacagcatgtattagaaattggcttatactttgaacaatttgacatgggtgggagtctctttgttctttgaagtatctattatgaaggatggttgaacagtggaagaatgagcaggataaaagtcaagtgtgtcagtagtccaacaagtgatggtaagtatatacttagggaaggaatcaagactatttgggccaggtgtgatgattacatagtcctatagtgctagtttacttggaagctgaggggcaggaagattgcttgagcccacgagttcaagtccagcctgggcaacgtatagcaagaccttatctctgaaaacaggtaataagacatctatgcttactgtacacactgctgcaataggctgctaccacaagtgtataggtgcttggttagattgagccatactagcggtttgatacgtttcaatctaacaaatacgtattcagcttttgtttcagtaagttgaaggtttgcagtatgattaagaattttttgcattgtaaggaagtatggttctggataatctttccagtcatgaactcaaaataagcataagtttttagggcagaattttgacacatggccatatgtattttgaagatagaaaagatgatggtacttgagtctcgatttagtcaaaataagcatggaaaggtttgggattgctagattggatagtcaatggctgaaagtgactcatggagtgaaacgatgctaaggagagttcagtttccactttatgtgaatgatgagtgaacatgacaatctgctctggaggaactgccaaaatttgaggttatttctagtctagcatggttaggattatggtgacataaatttagtatgtttacatactacattaatgtggtttaattttaattacacttaaatgcagttgtcactcttgggcactgttgatgtgtttcctggattcttggctgaatttcaagatttttaaaatggctttataggagctgtgtctaaccttcatgcttaaaatgtttcctttgctcctatgctctacgtgacctgcttgagtggccacaggcttgctctttagagcacagtgactttgttgatagggcctcactactcccacaatgcagagatacctacttattgtaggtacagggcattgaaagttataagactatctttgggttttgctttcttgtgttccattctatttttaatacaattctgagtatatttaaacctgctttgcttcatgtcctcatttcagtttatgatctatttttcagcatgtttagtgtcattgtttctaatgtggctgtcctctataatgactactcttcaatttcttcattttttttttcctcttagttttctctacatacacttgactgggtttttaggataattctgagaaaggacttttttttgacaaagcactgtttaattatattatgaaaggatattttgtgacttggaaagatgtttattatgggagaaaacaaaacggaccaatacgatttaagagcaggaaataggtgtctcaaaacaagataaagtcagcaattccactcctaggaggattctacccaggagaaatgaaaatgctaagtatgtgaatgttttgtagcattattcatcgtaaccaaaaagtggaaacaaaaatgtccctcaactgacaaatggataaactaaatatatacataaaatgagatactatctcctctaggtgaacagccacatccccaatttcctcccccctcttcaaagggtcattaggtaggcctatcagtactgtgacatatctatattctaaggctttctgtagatgtatatccagttttagtccttattttactgtgtgaagcagatacaatcatggtttattggatatttactgtcttccttgttacattgaagatgtttcatttttcgagagaagtacctcctatctttcgctggagatcctccattcacttccttttccactcattctattcccaacagcccatctcatttacctaacagtcaacattagtggtatgcagaatggtccctgaacctcttctccagacctcaatcacctgatgggatctttcagtgcaaggcgagggttgacttagggtgcaatcaaaacctgatttggtgtctgcttgagtattggcactgggagatgtagtgattaatttagattagtctttcctttcttggaacctagccattttccttttgtgtttctccaacttggtgttgcaacagaaagtacctgggaaatgattctagggcaactctcctaacaggatcctccacctctgaggttctctcagaaatctgtggttttggttttggtttttgcttgtgtttttattcctaaagctccccaggcaattctgatacagcaggcttaggtgtggagtccactgttcactccccttctttttgtcatttgtttcagacttagcattgccatgatcatgcttctggttcttcattgtggaagcatctctgtattccaaattaaaacagatattgcaaacaaagtaatggcattctattacgtggcccctatggcgtggttctaatctaccattgcagctttaacttgcctcccagaccttatcctgtagctgaatgtcatgctactgtctatgcaaatcctgtgctttcttctgcctttgccttagtttttgctcaccatgttccttctaactagaattggagctaaactaatgttttaaaatattgggctgggcgcagtggctcacgcctgtaatcccagcactttgggaggccgaggcaggcagatcacgaggtcaggagatcgagaccatcctggctaacacggtgaaaccctgtctctactaaaaatacaaaaaaaaaaaaaaaaaaaaattagccgggcaaggtggcaggcacctgtagtcccagctacttaggaggctgaggcaggagaatggtgtcagcccaggaggcagagcttgcagtgagctgagattgtgccactgcactccagcctgggtgatagagcaagactccatctcaaaaaatatatatatattgtattcagaatattaaggtgctggcccggcacagtggctcacacctgtgatcccagcactttgggaggtgggtggagttcaagaccagcctggccaacatggtgaaactccgtctctactaaaaaaaaaaaaaaaattagctgggcgtggtggcaagcgcttatagtctcagctacttgggaagctgaggcaggagaatcacttgaacctgggaggtggaggttgtagtgagccaagtttgtgccactgtactccactgtgggcaacagagtgaggttccatctcaaaaaaaaaaaatctctctctctatacacacgcatacacacacacacacacacacacaataaagctgccattgacaattactagtgacatagagaaaataacttgttccagtgggtagagaaaaaagtaggttacatctcagtgtgcagaatgatcttaagtattttgaaaatacatagaagaccagaaggaaacctgctaaaatattaatagtttttgctactggttgaaattataaagattttctgctgctttatcctttcctgagcagattttatacggttaaaatgtattttctaataaaactgtatagattcacaggaagttgcaaaaacaagagaggttccactgtatccttcacgcagtttcccccaatggtaacatctggcatactgcagtacaaaaccaggaaattgccattggtacaatccacacaccctgttccaatttcaccagttttactcatttgtatgcagtcatgtgtgtagttctgtgcagttttatatgtgtagatttgtgtaaccccctccacagaacagttccatcatcacaatgatctcccttgtgctacctctttttttttttttttttgagacagggttgcgcaggctggtgtgaccatagctcgcagtagccttgacctcccaggctcaagcaatcctcccacctcagcctcctgagtagctgggactacaggcgtgtgccaccacacctagctaatttttaaattatttgtagagatgggatcccactatgttgcccaggctggtcttgaactgaactcctcaagtgatcctcctgcctcagcctcccaaaatgctgggattacatgcatgagccacagtgctcagcttgctacctctttttaaatcgtatctgtccccttcctgcttccctaacctgtccccaacccctgacaactacttgtctgtttaacatctctaaaatgtaattttaaaattgttacataaatgcagtatgtgaccttttgagactaggttattttgactcagtataatgtctctgatcaatccaagttgttgtaaatagttttgttgttgttgttgttgttgttgttttgagatggagtctcactctgttgcccaggctggagtgcagtggtgcgatctcggctcactgcaacctctacctccagggttcaagcaattctccccaagtagctgggattacaggtgcatgacaccacacccagctaatttttgtatttttagtagaggcggggtttcaccatgttggccaggctggtctcgaagtcctgacctcgggtgatccgcccgcctcggcctcctaaggtgctgggattataggtgtgagccaccgtgcccggccagtttgttcttttttattgctgaatagtatagatattctgtagtttatccgttcagccgttgaaggatatttgtcttgtttccggtttgtgacttacaaataaagctgccatgaacattcagctacatatgaacctatatacaggttttcgtgtagacataagttttcatttatgtggcataaatgcccaggagtacaattgctggctcctgtgttaagtatgtgttagtttaaaacactgccataccatttttcagagtggctgtaccattttacattcctaccagcaatgcaggacagatccaatttctctgcatcctcaccagcatttggtattgttattattcttactattattattttttgagacagggtcccactctgtcacccaggctggagtgcagtggccctatcatggctcactgcagccttgagctcccaagctcaagccatcctcccacctcagcctcctgagtaattgggaccacgggtgtgtaccaccatgctcggctaattttctttttctttttttttttttttttgagatgtggtctcactatgttgcccaggccagtcttgaatttctgggctcaagtgatcctcccatctagcccagcactctcaaagtgctaggattacaggcatgagccaccacaccaggcatgtcattatttttaaattttggctgctctaattggtgtaaagtagtatcttattgtcttaatttgcatttctctaatggctggtgatgttgaacatcttttcgtgttcttatttgccatccctgtatcctctttggtaaaatatatgtctgtgtcttttgctcatttttaaattgatagttttttactgttgagttttgagagttctttattctaagtacaagtctttttgacagcttgcaaatattttctctcaatcaaagtcgtcttttcatcttaaaaaggtcttttgcagagcaaatgcttttaattgttcttaaacatttaaaagtttgatgtagtccaatttgtcagcttttttttttttttttttttgagacagtgtctcactctgttgcccaggctgaagtgcagtggtgtgatcttggctcactgcaacctccgcctcccaggttcaagccattctcgtgcctcagcctcccaagtatctgggattacaggtgcccaccaacatgcctggctaatggctaatttttgtatttttagtagagacggggtttcaccatattgaccaagttagtctcaaactcctgacttcaggtgatccacctgccttggcctcccaaagtgctggggttacaggcatgagccacctcgcctggccagtatttctttttttttttttttttttttttgagacggagtctcactctgttgccaggctggagtgcagtggtacgatctcggctcactgcaacctctgcctcctgggttgaagtgattcccctgcctcagcctcctgagtagctgggactacaggcgcacaccaccacacctggctaatttttattttattttattttaatagagatggggtttcaccgtgttggtcagggtggtcttgatctcccaccttgtgatctgcccgcctcggcctctcaaagtgttgggattacgggcgtgagccaccgtgcccggccggcatcattcgtcaaaaagaatgttctttctccattgaattgcttttgtacctttgtcaaaaatcagttggctgtccttttgtgaatctatttctaggttcacaattccgtttcattaatctatatgcctatccttccaccattcctgcagaatatcacactaattcttttttttttttttttttttttgagacggagtcttgctctgtcacccaggctggagtgtagtggcatgatctcagctcactgcaacctgtacctcctgggttcaagcgattctcctgcctcagcctcccaagtagcttggattacaggtgtgcgccaccacacccagataatttttgtatttttagtagagacaggttttcaccatgttggccaggctggtcttgaacccctgacctcaggtgatctatccacctcggcttcccaaattgctgggattacaagcgtgagccactgcgtgtggcctcaattatttttatctatataataagtcttaacgttgggtaggagtgattcctctcactttattatagttttgcaaaagtaatttagctcttctagttcctttgcctttccacataaattttagaataagctttttttctatctacaaaagaatcttgctgggattctgatggtaatgctgctaaacctatagatcagttttgaggagaatcgacatctttactatgttgggtccaaaacttttttatttttatttttttgagacagggtccagtcttgctctgtcactgggctcaagcaatcctcctgcattagcctcctgaatagctgggactacaggcacacaccaccacacctggctaatttttgtatttttatttttagtagagacaaggtcttgctatgttgcccaggctagtctccaatgcctgagctcaggcgatcctaccacctcagcctcccaaagtgctgggattacaggcgtgagccactgcgtgcagcctaaatttatttttatgttgtgaacttggaatatccaaccaacagtaaagattacctagtacttcctaacatgggattctcctatttgttcatcctaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcaggcatgagtctgtaagcattcttagtctgtaagcaccttttggaaggtttcctatctgggacagagatagacactctttttttttttttttttttttttttttttgagatggagtttcgctattgttgcccaggctggagtgcaatggtgtgacctctgctcaccgcaacctccacctcctgggttcaagcaattctcctgcctcagcctcctgagtagctgggattacaggcatgcgccactatgccctgctaattttgtattttttagtagagacagagtttctccatgttggtcaggctggtctcgaacccccgacctcgtggtctgcccgcctcggcctcccaaagtgctgggattacaggtgtgagccaccgtgcctggtcgacgctttctaatagtcaattaagtaagttaataactgcctgggcagaaaatgcagtattcagctaatcccaaacttggaattttctaccttttcagtttcatcttcttaaaactcatcattttgagagtactttggagttacttgaatattaattctcagcatgcattcaacttaattaccttaatgtcccaggattttaataacccttaaaatttccatgtcaattttcatcagggaaccttgtccttgaatgctgctgctgtgacttcctgtagaagttctttaattggaacactcttggcagagccttccctttcatatggagcacaaaagcagctgccatgctcaatttgcagtcctctttattgtgcggggattttttttattttttattttttgagatggagtttcactcttgtcccctaggctggagtacaatggcgccatcttggctcactgcaacctccgcctcccgggttcaggcaattctcctgcctcagcctcccgagtagctgggattacaggtgcccaccaccactcctggctaatttttgtatttttagtagagacagggtttcaccatgttggccaggatggtctcgaactgacctcaagtaagacacccaccttggccttccaaagtgctaggatcacaggcgtgagccactgtgcctggcctgtacaggaattttgaagaaatctacagtgttaacagaacccgtggtataaatttatcccaagtatcagtgtcacaaatactctttgcgtctaagaaacatgctttcttggaagcaacactgggaaaactaagtgatttcacttttgcccaccacaggaatgaagtcttactgcatttattagcaatacccatggttgaatctcttttacttattttctatttcccaaccttttcattttcttgcatggacatctgaaagttgcctccaggccgggcatcgtggctcatgcctgtaatcccagcactttgggaggtgggcatatcacctgaggtcaggagcttgagaccagcctggccaacatggtagaagcctctactaaaaatacaaaaattagccaggcctggtggtgtgcacctgtaattccagctacttgggaggctgaggcaggagaattgcttgaacccaggaggcagaggttgcagtgagccaagatggtgccactgcacttcagcctgggcaacagagtaagattccatctcaaaaaaaaaaaaaaaaaaagttgcctccaaattttggagtgagataaggtataagtatatcaaatgaaacgttaaagctatttttaaaaaagtgggccaggtgtggtggctcatgcctgtaatcccagcactttgggaggccgaggcaggtggatcacgaggtcaggagatagagaccatggtgaaaccctgtctctactaaaaatacaaaaaaaaataaaaaataaaaataaaaattagccgggcgcggtggcgggtgcctgtagtcccagctactcgggaggctgaggcaggagaatggcgtgaacccgggaggtggagcttgcagtgagccgagatcgcgccactgcactccagcctgggcgacagagcgagactctgtctcaaaaaataataataataataaataaatacataaataaataaaaccccaagagaggaagtagtgtcactccagccatatgtgtgccttttcttcccttagaagctttcaatttccggctgggcatggtggctcatgcctgtaatcccaacactttgggaagcggaggtgggcggatcacctgaggtcaggagttcaagaccagcctggccaacatggtgaaaccccgtctctactgaaagtacaaaaattagctgggcgtggtggtgcgtgcctgtaatcccagctactcgggaggctgaggcaggagaatcgcttgaacccgggaggcagaagttgcggtgagctgagaccatgccattgtattccagcctgggcggcagagtaaaactctgtctcaaaaaaaaaaaaaagaagctttctgtttcctcctagtggaggaggtatggagtgctcttgtttgtttgtttgtttgtttatttgagacagggtcttaccctgtcgcccaggctggagtgcagtggcgtaatctcggctcaccgcaacctttgtctcccaggttcaagtgattctcctgctgcagcctcccaagtagctgggattataggcatgcgccaccacacttagctaatttttgtgtttttaatagagacggggttttaccatgttggccaggctggtcttgcactcctggcctcaagtgatccacccgccttggcctcccaaagtgctaggattacaggcatgagcaaccacacccagcctagtgcctctgtttaaggccaaatcttctatttgtttctcaggaacctagcgcttgtggttgtctctcatctattcatgcatcatctatatttcccactctcctggctcactcccttaatatcacccatctttgtttggggggggcacagttggggtatagggtctcactctgtcacccaggctggagtgcagtagcaccatcacggctcactgtagccttgacctcttgggctcaagcaatcctcccacctcagcctcccaaactgttggaattacaggcatgagccacggtgcttggcccaatatcacccatcaagccctcttgatcttatgtccctctgcagcttgccgctctgttttttttttttgtactgccccctgcttcctgcaagacctcaaatccactgtgtctacttcttgccttatttttattctactctaatcagcttttgtcatcccaacgaagtggctcctataagtcacagtcggccgggcatggtggctcatgcctgtaatcccagcactttgagaggccaaggcgggtgggtcatgaggtcaggagatcaagaacatcctggccaacatggtgaaaccctgtctgtactgaaaatacaaaaaattagccgggtgtggtggctggcacctgtaatcccagctactcaggaggctgaggcaggagaatcacttgaacccgggaggcggaggttgcggtgagttgagatcatgccactgcactccagcctggcaacagagtgagattctgtctcaaaaaaataaaaataaaaaaaagtcacagtcacctattctttgtcgttttactaggcccttcagcagtactgtacactgagtacatcctcatggacatgctttagtccctaggtttccatgtgcgcacacttcttggttctcctccactttggcctctcatgcctggccctctttctcctcacaacccaaatattagacaatatatcacaaacaaatcccgaagtgctgggattacaggcatgagccactgtgcccggcctacttaagtattttcatagattatctaatgttcaaataatgcaatattcctcagcatctgaacaaatgcatggaatggatggtggatagcaagagatacttgtactttctctctgcctttccctgccttctccagggtccccccacatctcattaagtggcatcttctttcacctagtcactcaggtcaaagctgggaagtcattccttttttctttctctcataccacttgtcattgaatttcctaagttctatctccacacctgcccactgcatcatcaccactgctaaaatcctgagccaaataattaacttttttttttttttttttttttgagacagagttttgctcttgttgcccagactggagtgcaatggtgcgatctcggctcactgcaacctctgcctcctgggttcaagcaattctcctgcctcagcctcctgagtagctgggattacaggcgtgtgccaccacgcccggctaatttttgcattgttagtagagacggggttttgccatgttggccaggctggtctcgaactcctgacctcaggtaatctgcccgccttggcccctcaaagtgctgggattacagatgtgagccacaatgcccagctgagccaagttaacttctttcctcatctgaactactggaacagcctccttacctggtctccctgtctccatcatgacttactatacaagactcctgccaaccttccctcatccactgtgctcctatcataccagccgcctttcaatccttaactgcgccaagttcatcctttctgctggaacctcctttcttcacatggctgtctcctcctcattcaggactcaactcaagtgtcacttctcctgagaggctctccctgacatccttaactaactactctaattataaagttccaaggaagcgctacagaaaagacatccgtcccctgacagggctctgggctagtctcttccctatgggaggtggggcaggagctgctgaggctcatgattcttctttggccacctcactcccagctgatgagggacaggtcaaggacagcctgtgcttccactggctcctggtcactacatgtagcgcactccaggtagacacgttcttcctggctcccatattatgagctcatcagacagcctcccctgctgtcttcctgccttgaaaggatctaacatgaaagcacttttactttctaaaagtaaaatgctctctattcatgggcaagagattaccacctcactgactgggaccttcagctaatgcctttctttctgggcatttctttctttgctatgaagtgagaagaaccatacttgctgtatacaattaagaagtgatctattcaaagagccacttgatgactgagtgcaatggctcacacctgtaatcccagcactttgggaggccgaggcagtggattacttgaggtcaggagttcaagaccagcctggccagcatggtgaaaccttgtctctactaaaaatacaaaaattagctgggcatggtggcaggcgcctgtagtcccagctacatgggaggccaaggcaggagaatcgcttgaacccaggaggtggaggttgcagtgagctgagattgcaccactgcactccagtgtgggcaatagagtgagactctgtctcacaaaaaataaaagagttgatgattccatggttcctatggacatataatagttgactgtcacaaaaaatataactctggccgggcgcagtggctcacacctgtaatcccagcactttgggaggccaaggagggcagatcacctgaggtcgggagttcaagaccagcctgatcaacatggagaaaccccgtctctactaaaaattcaaaattagccaggcatggtggcgcatgcctgtaatcccagctactcggaaggctgaggcaggagaatcacttgaacccgggaggcaaaggttgcagtgagccgagatcgcaccattgcactccagcctgggcaacaagagcgaaactccgtctcaaaacaaaagaaacaaacaaacaaaaaaccaaaaccctgccgcaatccttccactactctcccatgggaggaagctcagagccaccctgaccgctcttcatttcaccacctctctccatttgtcagtgacctgaggctgcctcattgtttctgagcactgttcatatcagctgttcttccacgcttccttcagcctagaccccagaaacagctgcccctctgccttcattctctcacccttctgtaacagatatccccttccactccttccttcctaacagaaccccaatttggttcaggatggcaatgtgcctctctaagaatagttggctcctcagccttgtactccaggagagacttgcctcccagttccggtcaatgtagtaatgggagtaggtgggagtattaggtggaagtccatggggcgggtgccccttcccaagcaaagcctcacaagaggcttttggctctgctcttttttctctcctagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 3357 - DNA, 24728 bp, human
cctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaaggtaagcaggaaaacaagcgctgccggcttgcctaggaaatcgcttctttccaaaccgagcatttcatcctcctctcagacaaagagacaacctttaaataccacttaaatttgcattactttaatttgcattaatctgtagcatgctagcattgtgtttcttaaatgaacgggtctttgaagtctgtgacagagcagggagcctcctagaaaagcttgaaaatatcttttggtttgacttaaagagatttttcttttcaaactctctgcgtagttagatgtaactttgtgatggttcttatagttgaccccgtgaaagggggctgcgaagcagcaacttgccaacatggattcatggagcccagtatcttccccagcaccctcatcccacttacaatgggggcactattaacgcaggcaagactgcgagtttaaaagcgcactgtttacttttattactacttatgtatgctgctgatctcctgccagggctctgccggagtgctcagaatgacttcaaacaataggcaacatttatttctagctttctgtgtcacgctttgcaggaatcctgctcccttgcactcttctttcagcgtgcaggtcttcgcttccatagatgcattggggagcaccgggaggagatgaggatggatttactgtatgattttgattgggcaaaaagtccgaggaaatgcatgctgtttgccttggacttattgcagggggttatttttagtcatcagctcgtccctgcagcatgatgttcaaggagtgaccgggaaaggatgctcccaccagcacagagaccaggacctgtaggaatgactcctacctgcgggatattccgaggtttctttcaaactttggaatacaagttctctctttaaatgaacaattgagctgtaggaggcctgggcataactctttcttgggggacgggaagtttgattgtgtacagaatgttaatgactcagaacgcccagtaactgaggctcattgtaatagacaaacccagataagcctccatgagaggcagactcccatctttactgagattcaggtgcgggaaaggaagctatttggcaagatgggagtcccttgtacagttctttgtaactcattaataacagatatggctgctgtgaaacatgtctcttttcatttctaatattagtgtattttaattacaaggagctggcattggcaaattaccccaacacataagattaaataccaggtgcatttgaaaacagagagatgactgaaatggggagttgctgtgggtgtcaaccaaatacagcggggacggcacaatgcttctcaactgagcgtttaaaccagatgcaaatatctgctcattttcttctcatcagtcttactaattcaaggaaactttatggtcctgtttgccagttttcattgcaaattggtacacagtttatgcaaaacttttctgattttctctgataaccagcccaataagcatcgctgaatgaaaatctgatatttgaataggttaatttacaactttggggtattcattagtcaagaaagccataaaagacactatggattccattgctgtaaaattttattgtaatttttttttaaaaaaactgcggttagcaaagcatttagctgaatcaaaacaattttcttagactattattcagatcattacatgagagtatttgaacacaaaatgcaatgttttgcatcatttattttaaaatacatttggttcaggtaacgggagaactggctgaggccttcttacgactgtgtaccaagcagctgacacccacagatggaaatgtgcctgtggagttttcaatcttaattcgagttccaatgacactgtcaagggaaaaataaatcatttttcaatacatttaacaatttccaactcatttattttcctgggcccttgaaaaatgtggtgagtttcttggaattatagccaccaatggtggccagcaatctttattttaagaactcacaattcaagtactattattctctggttaattatttatttcatcaatttttaaataaatatttattaagcattttctagatgcccagtgctatgctagtcccgatggatgcaaaggtgaatgagacattgtcccatactctaattctcagtccatatgccatctctagttagattttggaactgaaatgggcattgccaatgggtaaagtgggcaataactttcctgttataaagaattatttaaaacagctactggtttctagatttacttgaaatgattctcactcatcagtgggttttctttccatttatgattaagggattcccctttggcctttttcaccagatcctgggtacacgtcatttgcacagctaacacggctagatctttccagcctgggtagaagaatcccggaaaaagacagtagtttatcctttctctgctctcctgagcaccctgtggaaaggaccatatgctgtctctattggggatgggtgtgagtcgcctactcagtagctaacatcagggccacttgatgaatcatcgaattagaaacatgcatatggaggaagatgcagtcactatccctcaccacttacttgtcccacccccagtatcaaaacaaatgacctctgggcctggcctaaattcaagaggcccctgggaagaagctgttggaaactcttccccaaacccaggtctccatcatagccacacagtgttgctttcaaataacccagtatggtgttttatcacgtgtttaggttactgggggaaaaaaaaaaccctgaaaacagcatcaccagggtccttgacttggtccttatcagcagataatcccccgtggttggattaaaatgcctctgactccctggggtgcctgactcaccctagccagccctcagcttcttggccagcggccttcgagcccatcctcacctcttcccatgacggccagtgactgcttctttgcccaggccctctgcactaggccagcagccagtgggagcagaggggatgggaaggcaggtggacagactgtgaagtgctaaggcagagcggggaagcagggctgtgagacagggtgggtgagctccagggcctgggttgctgtggcctgccctggctgtgatcagctgtcatttcctctttgtgtatgacactgtggaacatattaaaatttctctgggatggtatgtttggaattcctctgatgccccacctcaccaacttacccggacaataaaagcaaggttgtaagcctttgaacagctggctggctatatatttcccttctttctttcgcataatctaattcagaaaagaatccagctagactggcagtgccatgtctgggtacttgtttcctgcaagtccttcctcctccacctcctcccgccagtcctggaatcttcctgggtggcatgtggcttttcttttcttttgctcaccactgctcccagcccgcccccttttcccttcgcctgagctccttcctttgtcagctggctctttgctctgcctgttttccagacagcttgggtcctgttccatccggggagaacagcccatgggatctccccatctccatagtattcccaggatgtcattcttggcaccagctctgccgggctgataggactggggggctttttgtagtcccgagcctgaatccactcacagagaggagcagccacatggcttagctgccctttgggctgccgagagcggggctggagtgaccgggttggcaggaacgagcataccatcacagtgacccgaacatctccggcaaaggccttggggtgggagcgctatgggaatgcctggatgcacttcggcctacattaagagaaatgtggttattctctgtttcgggggagagacaagcggcttgaaacaaagccctctggatccttggccccttccctgccccctttcccggtctgtccttcccacatccctccctccccaaacagaaagaaagagagacaggacttctaatttggccagcacagacccgaatgtctttatgaaacccatttagtgaaagaaagaggggagaaatatattctgggttgatccgaactaaaaaatgcatggggctttggagatggggcgggattttttctttctttctttctgtctcttaagagcagaacaacagtttcgttgatgagttgcaaatggaaggaagtggacctctcaattagagattcccatttaagagcctcaatgtaaacctccctgtgacatccttaaaagatgctgctaatgtccctgggaccaaaaggtattaaacagcaagccaccaggcggcttcctattccttttctttttctgggggctttggtcgtctttttcaaattagctaaaattcattaaaggacccaaaaggaaaaatttaaagcagctgaattaaaatgagtctttccctgttagcctgacaagaagaaaaaaagaaaggaagaaagggaaagaaagagaagaaagaaccaattcccctccactaccacttcttgggttttaatatgaattattccatacaagtccctaggctagaggatctatttaaagacgcctggcagcatgaagggagagggtaaaaatacaaccactcttttgtccatcaaaggttttctttgggaggacattaagagcattcctgttttcttgtctgcccctgccagtggcaatgttccagctggtagtatccactcctcgcccatcaggtcagcaatcatgaacttctgtgtttaatttcaggagaaaacaaagggtgggaaatccttccgaaacccctatgtgtgtgcagcagggcaggggaggctggaactggaatcagtactctcttggctgtgcaggttgcatgctgcaaattcacacacccacacagttgagttgttgaggaagattgtgccgatggcattatttctgatgccagcttcccttgcatctgcaaagcttttttcttgtgtctctggcagtcatttgcttgtcaccattcatgtgcactgtccccttcatcagaggttctcagagcctgatggtcaaggatatgtcactagagtcttacccccagacccattttcaacagtaagaacgtgaaaccctggatggggtttgcaatctgaagcaactactttcttgttaggaagagtgctgactcagaaaattcaaagaatgggtaacttccgttggcgacatatccccagtgctcataatcaggaattcatccagttggggtccatttcaccctcatggcaaaatctggacataaacattgactagtagctttaaactgggtataagatttgcaacagataacatttttgtcttttcttttttcttttttttttccacaaaagctaagaatttttcagacaatttgctctcttccaaggcctggatcaatcccaactttttcttttaagccatgatccaaccaattgcagtatcctttaaaaatgaaagggcaacaggctaagacattcaagaaagttgataagctgtcagaaaatgctcaagggtggcctttctacagtgccacaaaccaacaacagccctaaacgtggagtcctcttccatcctttcatcagtagggaataaaaatagggagagagcaggtcaggggagaagtaacaaaagagaagtaagaaggattatttttgatgttcaaaatctgctgctgccctttcaatattttcaaatatcacaatttcagaaagggaaggatccctttatttcacccactctccctcccaggaaggtgtttgaagttgctgtctttacctgaaaaggaggtcaactcctcaagtgaaaaaacatcccctatcttcaactcgaagtaaaatggaggtacacacatttgtacctaattatgtgggtacaaatataatttgtatccacaaactataaaggatgtaaagaatcaaagaaatccaatccttaatcaaagtccaatttttctttaaaacttgagaggatattttagggctcattgcattgctgtgatttcactgccccccaccaaattatgaaaaattactccttttcagaatttaaatttttcttttgagatgtggaatccaaaggcagcagaatagtattgttacagggaagctggcagtcaaaagacatagacatagctgcagcatgcatggtttaagcaaatcaagacaagcagaaaaccaccaccccaacaagttcagggttatcagcaatatagggacacgtatttttatgtgatttttatgagaaccttgcccctttgacatatgtctgagtctaggagcattccggattgcaacgggattgaattcagtattcaaatcccaccattgggcagaaaaggcaaattgaatggggaatggaaagactgagttgctcctattgtttatgccccattcctaactaagggctctacagctgttaggtgagatcactacccaccattccaaagtgttgttgcgggtgaggaggttcaaacgcagctttggaaacactttgctgcactctttgaagaaaggccaacatgctcatttggctctagggtaaaagagagcctgtaccctgagctaacattggtcacctctcctcctgaggccataccacagccagcagtacagcagcagaacaagtgtttagttgtttcagcacaggtatccccagaacacctggcaccttttcttttccacagggagaatgtacattcatgcattttggcaagactgagtcctctgagttgggtgtctcggaactctcctattttccttctaaagggtcttatgtaaggtgagcagtagagtgtgtctcattcctcataaaaaatccccttcctgggagggagtgggtgaaatgaagggatccttccctgactgaaattgtgctatttgaaaaaattgaaagggcagtggcagattttgaacttcaaaatgaatccttcctcctcctcctcctcttttgttacttctcccatgacctgctctctccctactttaattccccattgaagaaaggatagaagaggactctgtgtttagggctactgttgatttgtggcactatagaaaggccacccctaagcattttctgacagctcatccccatctcagtcacagcttttatttgggtagctggatttacagaaataatcaaatccctagaggaaaagacttcaacagaaaagtacctcctgacacttgggtaacctgacttggtcatttccaatttatgcaagatttgtattctaaaagtcaattagttatgtcaactgttaaaaactcagaatgagtctttccattcttcagaatgactcttttctgattatctgtgggccatagaagcccacagatactcagcacaggatccaagtgccataccaagtggtcaactcttttagacgtaagtctcagcccagggcttctggaatgtacctcccctagcagagaagctctgtagtagatactttaccaagcacagggcctcgctcttgaccccaagactactgattctacttgcagagaagacaacttttctaatcaatctttctcttctatcctgaaccagagtatcagagattgtcccattagggcacgaggatctgtggctcaagctcagttaagaaataagcgtctttcaaaagaaaggtgcaagagggtggaactcagcctatattgtcattatcaaatgcaagaagtctaatcctagcatgatttattaatattagcctttcttctctccccgtttatgctttggtgggtactggacagaaaccccacaaattttaagacagttttaagagaaatagtaactggttaaatatcctcactacttcaaattattattattattattgatattactgttaacttttgtttttttgagacagggtctcactctgatgcccaggctggagtgcagtgatgcgatcacagcccactgtaggctcaaccacccatgctcaggtgatcctcccacctcaacctcccaagtagctgggatgacaagcgtgtaccaccatgcctggctagtatttttttattatttttgtagagatgaagtctccctgtgttacccaggatgatcttgaactcctgggcttaagtgatcctcccaacactgccttctaaagtgctgggtttacaggcatgagccgctgcacttggcccacttcctatgattaacaggatattattaatttagaaactatttagtacatggcaagcactcagtcaaatggttattaacggctgtttttatttcaggccaccaatatagcttcatcaaggggcaaatacttatagcttgggcttcagtgttggatcagacaccaccttagaagttttttgcaatcattaactccttaagtaagaagggaactctttttgtaggattgctttggggaatatgtagccccaaggcaggggctgtactctgagaagcttgggtagagttggagactgttagaaatggatagacacataaaagcatttagaccaatctgttcattttgcagatgaggaaattgagtcctagaaaaggcaagtgacttgttcaagatcacacagccaatgatgggagggtaggactcagggcttgaggatcagtttcagaatgcagtgaaattgttatcccatatttctttcaaatcagtatagggacacggaacactaacaacataggcgaccaatgggtctagggaggaaaagatgaaagctgtaggtaagtgggagtttggataacaatgagatgtttttctggagttcctgacaatgcctgaaaaaaaaagtcaggattttaagcttcagtcaggctcaaggtcgagtcctcccactccagtccctcctcagacagtaaaacttttcaagccaaggacatacatataggtgggggcatttgacagttggctcatctccccaccctccaaattatttatatttctagtccttcagtttagcactcctatttaccccaggattgtaattcattgcctctttccctggccatattcctccatcctttttgtttctcccatctcttttcttcctccatcacccccactgctgagcttggctacacttggctagtagtgcaggttgggagaacacagagtcctatcacagactggaggactattatttaatcacaagaatgttgtcttttttctcctaaggtagcactctggggacggtcattgctgtctttattccctcacccccccaccacccctgcactggattagacacatgaaatgtgcctatctctgagatgaaaggagcaagaactgcttcctccccactgaccttttgcctgcccatccttggagatacctggagttggcaggctggaggcctagcagcatttgcagtcagtgccgctgcctctgggtcagcccaggcttggctccttggctgctactgatgtgctgccagctaggaatattaaaaaccattcattgaacgcacaggatgctttataaaatccaacatgctgtttacagtttataaattaactgccttgggaagaggcatttgacttattctccaaggcatctagttgactagatccaattggaatcctttgagttcctgggaaggggctacttaacacttcacactttctaaattagacctagagtttcttgcttttctgatcctagtactgtatgaagttttatctagggttatctagcaagctttcttccacttataaatctttgatgtttttgcaatttctttgatagaggctttatgttctactatcttcactttatttatgcttcataccataattttttaaaaaattacaataaatatcaagtaattctggctgatatactgactccattccaaggtcattatattttatttgcttaacttggtcttcttagaaatgatgcaatgaatactggatacaaattagatgttcagagagtttatcaatgtgtctaaaaaccatccaggaaaacaacaggccaagactctgcctgcagagtcagtgagctagaagagggatcgaggataggaactatatttttcccctgaccctatctcttatctgctagagcaaaaggagacacacagtaggtgctcaataaatacatgttaaaaaatatttgttgaaagaagccacagaagggaatatcagtatacattagtattgaaaacagcctagggggaaatatggatactgaagcaccaccctcctgtgcctggcaagcaaggcaagaataaggccattcttggcacataccacttagcctgttgctgagataacttgcgtgaaaccagcactttaccctctgccagccagaaggtcagcccaagagtgagctgatctgtgggcacaacaccatctctcacccaggaggctgggcccgctgtaagctctgctatattatttccctgaggatgacaggtggggaaatctgggcaccagttgttcttttccactggtatcatttggaaggtagctccaaagtcgggcacgccagcctacgtgcctctcctgccggcagaggctccacattggagctattagaatgtgggctctgtacgtcggccaagtccatgtctcagagactgtatccagagcatagcgtggccacagggctactgagttcagcaagagagtcattctcttgttcaatccattattgcctgggccaaggttctaagtcttcgtaggcagcatttgattttatgacacgtcttaaaaaattaaggcaaactggaattaatttagttttgagaaaacaacagaagctgctacaaggcagagataattctaggctgccagaaagtggtgatctcagtggtgtacattttcttaattcctgattttcctctttgtgaggtcttcctcccactcccatactttgcacattctcacctatgcacaccctgagcaacacaatgttgacaacttgacttagcattgctcttttcttaagctttgttttcatttcttcttcaatacaacagtgttggttcattcaatttgaacactcaaggcaaaaaaaaaaaaaaaaatcccaggttatgttttcagaatcttacctttttgtttttgttttgagggttctgtgagttttgtggcatatttacattgttgcttacattcttatttcagaatttaagataaaaactgggcaacaactctcacgttttctgagtgtgttgaaatgaaaaatctgtttcttagaattaatggtaaagcaacatttcctgtcaatctttcattctttaatattacttctgggttcagctcaccatctctaaagagaaagccagatgatcaagttacattgtatgtgacattaactatctctttatctgtgtaaatgtcataatatctgcttgcaaagtgttttattcatttttaggaaaaaattttaaactgtgcttgcaattcaggatggtgctactaggtggcagtaatgtacaagaactatgtggtcgccctggaagagtatttgactaagagactagcatgccttcccgtaattataagaaataaaaatataatatttttaaaatactcaaactggcacaaacagtaaacatccattaacttagttaccatatttaagctgagcttttaaaagagaaagccttattttttaatgaaattttaaataaagtatacattcacaagctcaaaaatctaaaaatacgaaaagatatatagtgaaaagtctttctctcatgcctgtccctcaactaccacaggtaactaattttgttagtttcttgggtatcctttcagagctttgctatacaaatatgtgtttttatctctctccattttaactcaaatcaatacatagagtttctgcatccttccatatatagttggttagtatattgttgtgtgaacattttagaatataattaaccagtcccctattaatggatatttcatgctgtttccaattttatgctatttcagccatgtgctcatgtgatttcacatgtaggataattcacagaagtggaattgctgggtctaaattatatacatttgcatttttaaaaggtattgccagattggcctctacagagtttggaccaatttatactgaactttctccaaaatggacttgttttcccacagccttgccaatagggtgcatgatcagacttcggaatctttgtaaatctgattggttgaacaatgtatttcaaagtactttaattttcattctcttaaatgagacttttattctcttaaattctcttctatctttaagggccctttatatttcctttttctgtggagaaagtggaaatgccaataaatacaacgatgcatacacatgtatagggttttgttattgatgtagcttgtttttgccatcatgctgtacatgatgttctttaatttgctttgctcatttaaccatacctcctggccatggctctgaagagaagttgctggcagtgcagaagaagggccaggactggaatgtctgcttctctcttcatccttttgccattgactcctgggggaaatatctgtagaccgaagcagtgaaatctaatcaattctctttctgacactaattaaggcttcaaagagacagataaccacttgggataatttagtcacagtgaaacttgggaaatggtcagtaatatttcatcctctgaaagtggaccccaagaaagttctggctctttgagttgttgtcttggtaattttcagggtaacgtgtataggaaaacccagattatgcagatgaaaagaaaacaaacatgctcttctgcatcctttgcagatttgaaactttgggcacaggtttgatttatttcaatgagatgttgctattagcatgaacataaagtggtgcaaagttgtgctggaatatggtctcgtcaactttgggctcactgtctgcatatggagatgatagtaactgaatccatagttatcaagtggtggcattttagaacacaaagggacagcagatgccatctctgtcaactccttccctctacagatgaggaaacttgggctagaggaggttgaatgacttgtgtaaggcttccccagctaattaatggcagtgccaggactcaagtccaggtgggttccctcattactggtccttgcccttcctgcaatttataggacttccctgaggcacatgtgctgaggctttgctattgccagggattctgtgctctgaaacagccctatctcacacacccctttccacttaggatcccctacctcacacttccaagacagctaattgaggctaaatgggtctgatgccattctattagtgcaaaataaattggcttatgccaacttgaactcctaatcttgattttatcaacactttgccctgtttattcagactgttcatgagtaggaagttaaggaaaatgttgcctatgaacaaaatgatcaaacttttatctgaaatacctttgaaagttttcccgaagctttaattatcatgttccttttgttttggatgtaatagcaggccctcccaattttcctaaatgtttgaaaatatttttgatactttctgtcttctgttgtggttaaaaaaaagaaggcaccagtgttggctatgcctggggagttagtgaggtaatctggagagatctctggaccccagtcctttgtccaagaggtatggtcaaaagaacaaagcaaatttcagaaaaaccggtataatatgatcctattttaatggtaagtctgttccaacaactgctttctttttcgaattacaccatgtgcccaggctacaaaggctctgcagaaatgtgactctgttggcaaatacgcgtgtgataccttaaccatgctggaggccagttagcataatgtgtatttcagatgcagtttgtcatcagtgctgggtgctatggggcttaaaacaaaaacaggatgagcctagagcacagaagtggaaaattaggtgggtgggtgagtatggacttggaaatggaaaatgtgcttccctgtgggacatggcttgtgttcattagtgctgacctgcctcctctctagccctgtaagctgacgctgacaccaaagcttgctgagaaactgaatagaccctcccgccccgaccaaccaaggacaaagatgagaccacccaattcggttacgttgttgccagaacaacatgtttaatctttaacatgggttcaaactattcttggccctaggaacatggacttcagcaattaaagtcaacatgtgcttccattaaaccattgtgtccacctccaaatggttataaatatgtagcataagctatgggagttggggtggaatggatgacagcctttgctaatgacgctctagaaaccaatattctcctctcaaaataacatggaaaaattctacttaatacctcctgggttccattagtggttctgggtaaataattctggggaaagtaatttctgttttcattccagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaaggtaagaccaaggtctctgtgaggagagcatttccctcagaaacaggcaagaagccatatttctttgtcaggggatggagaactaagatcatagcccaaacttaagtgatgtggctggcccacagggcttgtgggagaatgaggcttttagaatttccccccgtgctttgcactgttatcagtaaaagtgcctaatcaatcatgtgcacacccatccagtgggacaggtgtcctttgtccctggctgtgatgtttatgagtggtagtgtgcttttccaaaaaagaaaaatggagtttacaagtcatcataactctctagctccatcatcaataaagaggaagagaatgcaaagaatgcgattgagcagtggaacatacttcttggagggctctttaaagagattcttggtgaaataactggctttgtggtctgagcctttcttcaggtgctacatttctgttcaaatgatttcaaaagataagatggcaatatgatcatttatcatttttacattgcttatccaaatcgttctcatttggaaaaggatgcatgtttcttgcagaggcagtccgtgcctcagtggtgtgcaagggaatatcatgcttaaaaggccaccaagagtggccagctacatggaccacccagaagggaggcacattgtagggtggaacatacgagatctcacgactgtcactgcccctaaacaggcacaatgaatgaaatttgtccacacttggtaaataataatttgtttagcccaacctcagagatttttacatttagttttgagatgaaaatcacttaaacattctcgtatggcaagtaatttttgaaattaccagtataattaagaattttttatagtatcaatcaccagaattaagaccatataagccaatccctccactctccattcaaaaacattatgacttttgtatgccttgaaaatttccattaatttctctgattatagctcagtgatgatgattcattttagtttaggaggatcagaattcgagttaaatcattttaaccattatattaataagatctatgactgtgggaaaaaatagagattttccacttaataaaaactttctggctcttatttgtgcttgtagaaccaaaaaaaaatggagtaaatagatgaacataaatttttgcagggccacaattccttcttaggaaagggaaactaaaacaaattgagaaaaaacatgagaagtgcttttacaagtgtgattgctcagaaattgtgggcccatgtaaggttgactgcagcaattattagtttctccttccctcccccttcagaaacagacagcatgaatatttagtgattttattccatggataatttctttccgtattgagttgtcctccataatcgtgattcttttttaaaaaaaggaattaaaattatttcaaagaaagtgtcactatgatgatagaaaggaacaaagaaataggagcatctataaaaactagaaaacaatctggaaagactggacaaaatgatggaggagtactttggcaacaatcacattaatctagcgaaggtcaaagaagagacatcatgaactcaaaccgaagaaattcacatgtgaattctgagcatgagtcttagaaacagactttagtgtactgttattcacctttgtttcttccagaaagccatggcaaataacagcgcaaaattgtgatagcaggagaaatgtttgtaatttcatgggaacaatctgttttcaaacatcccaaactatcccaaatatagcaatagttttatgtaaatggtgcttgcaattataaacctttcttccctggccataaaatatgcctggcaaaatctcaactacccagaccttttctaggttagatttttctctatgtatccaggagcaaaactgttttcatttggaaatgttctataattcttaactcttacattctcgggctgatcttttctctaatgggtctcacttaatgaaattgtttgcctttagagacttggataaaacatttagcctatgtctagaaaagaggcaacaacaatctaccctagcttctttttacaaagaaaagactgggatagatttttttgtctctataaaaattatcccttgacatcatgttcaagggtcattatttattaaacatgtgcctactgtttgcctgccaattgttaatgctttctgactcacatttatccattatctggccttgtaaaggcaagaaagggagaatgtgacccaggctcagggaagggagtgtacctgcttgaacacctaatatatgtgtcaggcacctcatattgtatattataatcattgccaagaaacctgtgatggcaggcattattattcccattatcctggtaaggaaaactgaagcccaaaataattagattgcttgatatcatatagccagggagtggcaatgtctgccttacagcattcatcttcccactacttggatcttcatattggaggaacacaagtagaatgtaggagccatcacatagaagttcaggctctgcttctgatctgctggcagtaataatttatactcagcaatgtttctagaaaaaataaataatagtgaaagcctttctgggagctttcaatgagactgttcatcccagccctgaacttgcagctggccagtcctaggtccctgctgcccatctcctagcaattccggaaaggactgagagggagtcaggcagaaaagactggccacagtggcccaccaaagaggacagtgtggccacagattaggatgtgcctgatagttttaagtggtggcacctcctgggtttgggtacaaaagatcctgggagtagcaggttcatttataatcttcatggaagactaagtttctctaaaatttggagtaaaggctgtagagcaaacaggcaaaagaccagttgatagtggaaacagactgcctggtggaatctctatgagaactgaggcatgccaggctttgaagtgagagagacctggtttccaattccagctccatggcttgccgaatgagtgactttgaggaagttcagtaacttccttctttgtgcctcagtttcttcccatgcaaaatagagctgtctacctgagggtatgggtatgggtgttggtgatttgtaaagcatccagcggtgtccagcacataatagccatttaatagaagatattatgatcttgatgataaagttataaactaagcaggtgtttagactcaattttctatttcagtcacaactgagatctcaataactgctgggatctcctatagccttaaaagattaggaaaatgaaccttattgtagttcttgttaagcacagggtggggcagaagagcaaagtaaatgtaagccactgtgctgggtgctaacagggaggataaaagtaaaagagaaacagccccgatatctgtctaaccttccttcccagatgagtggaggaaggaggggctggagggggatgagttttggacttgggccagggaggggatttcaggaatggagggtgggaaagcaaactggcagggaagacctggaaagtctcagttgggtgaggagtgggggatgctggccccaggccagggcatggaaccagggcatgactatctgaaccggtaagggccacaggagcaggtggggaactggaagagcaacaacaaaggataaggaggaagaggtttgggagacaaaacctaggaaaagaggacctggtatgctaagggctgagtcctaacagcttcctaacaggacccccaagccatcttctactgctacccaccaagctcatggtgtgataggagaaatggagggagtcaggaaaattgtgtttataatacaatagacttcttgagagatataatttgatttttttaaaaggaacaaatttatactgagtgcctaccatgtccaggtgctgtggaaggtgctggagactctaaagtggaaagaaagaaaaaagagacaatttttttgccttcatgatgcttacaagaaaatggggagagagggaggaggggtgttctgtgcacaaagatcagtttgtatctgtttgattcatgaccggagtgaagggaccagtttctagttggagtgagctgagttcccatccaccctttcaaagcccccaccatctctctgctgctttgttccctggttgcaattttcttggtgccctcagcctagcacagatcttttggaggttgacctgggtccctgaagatgagcggagttatgaggctgcccgtggggaaagaatgggagaagaagcatgggtgaatcttgttcctgaggttatagagggtgtttcaagaggtgccatggaaataagggtgcatagtgttcactgctgcgaaaaaggcaaaatacttttccactctgtcggagtaaaatcgcaaaaatgctcttctagggtgggacaggtgggtctttattctgatgctaatggtgacatctggtcagtcaaggctcttggaagattcagctctgcataagcttggggatggtgaagctaatgtcccaagaagcccacaagaaaaagttagacttgtatgtctatggatatggtcaggggtttctgaggcaaatcaatgtagataaggaagtctgtgagttggcatatgcttgaggaaaacatggtatcaggaggcaggtattatactggtttaggtcagggctttggtttcagatagaccttggtttgattccagctctgcattttaccacctatgtgagtttgggcaagttactggaactctctaaagcttgagtttccttatctgtcctaatagtgtagatcataacagtactttcttgtagggttgttgtaaggatgaaataactcacattgcaagtgctcaataaatgttcttattagcgaaatgatggttatctagtgattcatctagagcacagccctcaaacttgaatgggtccagagacctgctactcaaagtgtgggcaccagcccagtaggactgacatcaactggaatctgatgggaaatgcagaatctcaggctctaggccagaactactcaatcagaacttgccttttaacaagatcctagatgattcacacgcacattccagtctgagaagctctgatccggaagagatcaggagatgttcaagtgctgaaacacaagtaaggcatggcagaagctaaaatgtgaagtattgagagtaaaccaggagagcagatggttattccttccatcccttaaggatcttatctttcaaacttctgctttaccacttcaacacacaaaacagagatagatttccttctaggagtgtgtgtgtgtgtgtgtgtgtgtgtgtgtgttgagaacatcaatggttcaataattgcttcatagtcttttcttccaggaaagagcatttgaatttggctacagagaatagataggtgggattttattaggcagagcaaggtggaaaggacatatttgggagacagaagacataagcaaaggcaagaggcaggagaattcagggcactttcttggactcctaagtagttaagtttgactggagtagggagtgggtagtagagtgatgagaatagttgtaagtaagactggaaatacatgtgaaacctgggtcatgaagggccttgactcctcttcaagattttggattttattctgaactactgaaggcatttattgtacatgtctgtgcattcttcttgcacaaacagtccagctcccaaggaagaggggcccagcccattggaggtggccccacgtccttcagtgcctggagttcttgtccttcagagtgggctgggggtggagctggacatcctgaaaacttttagtgagattgcaatcagatgagctcatttacaaatggccctacgctgttgacttggtcattttatggacagtgctaatggcccagtcagttaggcctacgtttggttcacctgtgtatacatcacttggatattatgtcccatatcattgttggcccttctgagttaagttcgttggcacagatttactttgtccacccagactgaaactgcacctctgaagactccatcacggaaggtgactctgtgaataactgcttagtcaacctaatagatgatctagatgagagattagcaaatttaacactactccaaggtgaggtatcaagcagctcttcccacatacagggagatggggggagaacagactaaggaagatcttggactctctctctcattagagaaatgggggtgggaattagggactagcctgtgtactactgacctatggcatagtctctcaaaacccatttcagagccaggcacagtggtacatgcctgtagtcctggctacacaggaggctgaggcaggaggatcccttgagctcaggagtttaaggctgtagtgtgctatgatcatgcctgtgaataaccactgcactgcagcctggacaacatagcaagactctgtctctaaaaacaaaacaaaacaaacaaacaatcatttctgatagtttactttgcctgtcaaaatgaagagcaggtaggatagaatcaaaagctttaaaaaaatcaaaacagcttacagctgctattttctctctgcctctgcgatcattcagagaaaataaattcactggtctagtccaacttattcttccctaagccctgctgttttttttttctagtatttcatattgccttggtggttgctaagtgattgttggatttagccccagtatattctcagataactatgccaataatctataattaccagaattcatcttttctcccttttggaaagatggactggctatttttttcttgtaaaccttgggtgtttaattctgccctacaggatgatgtcagagataatagctggtgagtctttaataataactgcgaattcctacaatattgtaaggtaaacgtcaaaaggtttcatgcatatatatgtatcttttaatctttcatttgaacagtttcactttttatgatcttgctgttggttctggaattataggacaaatttttcttttcttttcttttctttttgagacagggccttgctctgtcactcatgctggagtacagtggcttgatcatagcttcctgcagcctctaattcctgggttcaagtgatcctcctgcctcagctgccaaagtagctgggactacaggtgcacatcaccacgcctggttaactttttatttttttttttagagacacggtcatgctatgttgcccaggctggtctcaaactcctggggtcaagtgatcctcctgcctcagactccaaagtgttgggattataggcatgagacaatacacctggcccaggggatttttttctccatcacttaacatgaaattcaccaagcaaaacctcttacataaccatgggaccaataatctcagattctccattcccctccccaccttgatattaggattatgcagcttaatgagtcaagctgtcccaccctacccacctattactcccactcccaggataccaggagttttgtatgggatacataaatgatccttttttccattccgttaagctgtatgcaaattgtgtgtgtgcttatgtacatttttctggggataactttggtagttttcatcagattcttaaaggtgtctgtttgctaaagccagattaagagctactataaagaacacatagcctccgttattccagcccaatctttggaaatagagattatcagaatgggtacatcctaatatttgccgcaaatgactctgaagatgcggatgcaattacataaatcccaggctccttcaacatataaacccagaagtgtgatttcagggccccagacatgccctgtctctacttcattctcttgtcccaaattgcagcacccagaatatttcttcctaagcattactcaggctatcctattttcttattcagaaactatattcctgttctttagctatttcctgcacaaatcaatttcttttttttttttttttttttggtagtcattttaatttacttcttggtttcaatttggattgactttctgcattttgctactggtagaattgcaatgcattgggccagtggtagaccactacctgtcaggagaaatttcttttgttctttggtttttactcgcacatcacagtgatgggcgtcattcagtggttctaaaccctcagtacacttagaaatcacctaagaagctttgaaaaccatgaaagcctggtccctatctccaaggattttaattcaatcgatctgaatgaggcctgggtgttgacttaaaaaaaatgcaacatgcattgagccactggtctaatctagcaggaattggcaacgagtgtgagggtctttcaaaagatgctgttttacctggctaaggttgtggcatgcccacagagtaaccacctccttttctttccccagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaa

SEQ ID NO: 3358 - DNA, 23704 bp, human
gaacaaaagcatttggaagtaacaggacctctttctagctctcagaaaagtctgagaagaaaggagccctgcgttcccctaaggtaagcaggaaaacaagcgctgccggcttgcctaggaaatcgcttctttccaaaccgagcatttcatcctcctctcagacaaagagacaacctttaaataccacttaaatttgcattactttaatttgcattaatctgtagcatgctagcattgtgtttcttaaatgaacgggtctttgaagtctgtgacagagcagggagcctcctagaaaagcttgaaaatatcttttggtttgacttaaagagatttttcttttcaaactctctgcgtagttagatgtaactttgtgatggttcttatagttgaccccgtgaaagggggctgcgaagcagcaacttgccaacatggattcatggagcccagtatcttccccagcaccctcatcccacttacaatgggggcactattaacgcaggcaagactgcgagtttaaaagcgcactgtttacttttattactacttatgtatgctgctgatctcctgccagggctctgccggagtgctcagaatgacttcaaacaataggcaacatttatttctagctttctgtgtcacgctttgcaggaatcctgctcccttgcactcttctttcagcgtgcaggtcttcgcttccatagatgcattggggagcaccgggaggagatgaggatggatttactgtatgattttgattgggcaaaaagtccgaggaaatgcatgctgtttgccttggacttattgcagggggttatttttagtcatcagctcgtccctgcagcatgatgttcaaggagtgaccgggaaaggatgctcccaccagcacagagaccaggacctgtaggaatgactcctacctgcgggatattccgaggtttctttcaaactttggaatacaagttctctctttaaatgaacaattgagctgtaggaggcctgggcataactctttcttgggggacgggaagtttgattgtgtacagaatgttaatgactcagaacgcccagtaactgaggctcattgtaatagacaaacccagataagcctccatgagaggcagactcccatctttactgagattcaggtgcgggaaaggaagctatttggcaagatgggagtcccttgtacagttctttgtaactcattaataacagatatggctgctgtgaaacatgtctcttttcatttctaatattagtgtattttaattacaaggagctggcattggcaaattaccccaacacataagattaaataccaggtgcatttgaaaacagagagatgactgaaatggggagttgctgtgggtgtcaaccaaatacagcggggacggcacaatgcttctcaactgagcgtttaaaccagatgcaaatatctgctcattttcttctcatcagtcttactaattcaaggaaactttatggtcctgtttgccagttttcattgcaaattggtacacagtttatgcaaaacttttctgattttctctgataaccagcccaataagcatcgctgaatgaaaatctgatatttgaataggttaatttacaactttggggtattcattagtcaagaaagccataaaagacactatggattccattgctgtaaaattttattgtaatttttttttaaaaaaactgcggttagcaaagcatttagctgaatcaaaacaattttcttagactattattcagatcattacatgagagtatttgaacacaaaatgcaatgttttgcatcatttattttaaaatacatttggttcaggtaacgggagaactggctgaggccttcttacgactgtgtaccaagcagctgacacccacagatggaaatgtgcctgtggagttttcaatcttaattcgagttccaatgacactgtcaagggaaaaataaatcatttttcaatacatttaacaatttccaactcatttattttcctgggcccttgaaaaatgtggtgagtttcttggaattatagccaccaatggtggccagcaatctttattttaagaactcacaattcaagtactattattctctggttaattatttatttcatcaatttttaaataaatatttattaagcattttctagatgcccagtgctatgctagtcccgatggatgcaaaggtgaatgagacattgtcccatactctaattctcagtccatatgccatctctagttagattttggaactgaaatgggcattgccaatgggtaaagtgggcaataactttcctgttataaagaattatttaaaacagctactggtttctagatttacttgaaatgattctcactcatcagtgggttttctttccatttatgattaagggattcccctttggcctttttcaccagatcctgggtacacgtcatttgcacagctaacacggctagatctttccagcctgggtagaagaatcccggaaaaagacagtagtttatcctttctctgctctcctgagcaccctgtggaaaggaccatatgctgtctctattggggatgggtgtgagtcgcctactcagtagctaacatcagggccacttgatgaatcatcgaattagaaacatgcatatggaggaagatgcagtcactatccctcaccacttacttgtcccacccccagtatcaaaacaaatgacctctgggcctggcctaaattcaagaggcccctgggaagaagctgttggaaactcttccccaaacccaggtctccatcatagccacacagtgttgctttcaaataacccagtatggtgttttatcacgtgtttaggttactgggggaaaaaaaaaaccctgaaaacagcatcaccagggtccttgacttggtccttatcagcagataatcccccgtggttggattaaaatgcctctgactccctggggtgcctgactcaccctagccagccctcagcttcttggccagcggccttcgagcccatcctcacctcttcccatgacggccagtgactgcttctttgcccaggccctctgcactaggccagcagccagtgggagcagaggggatgggaaggcaggtggacagactgtgaagtgctaaggcagagcggggaagcagggctgtgagacagggtgggtgagctccagggcctgggttgctgtggcctgccctggctgtgatcagctgtcatttcctctttgtgtatgacactgtggaacatattaaaatttctctgggatggtatgtttggaattcctctgatgccccacctcaccaacttacccggacaataaaagcaaggttgtaagcctttgaacagctggctggctatatatttcccttctttctttcgcataatctaattcagaaaagaatccagctagactggcagtgccatgtctgggtacttgtttcctgcaagtccttcctcctccacctcctcccgccagtcctggaatcttcctgggtggcatgtggcttttcttttcttttgctcaccactgctcccagcccgcccccttttcccttcgcctgagctccttcctttgtcagctggctctttgctctgcctgttttccagacagcttgggtcctgttccatccggggagaacagcccatgggatctccccatctccatagtattcccaggatgtcattcttggcaccagctctgccgggctgataggactggggggctttttgtagtcccgagcctgaatccactcacagagaggagcagccacatggcttagctgccctttgggctgccgagagcggggctggagtgaccgggttggcaggaacgagcataccatcacagtgacccgaacatctccggcaaaggccttggggtgggagcgctatgggaatgcctggatgcacttcggcctacattaagagaaatgtggttattctctgtttcgggggagagacaagcggcttgaaacaaagccctctggatccttggccccttccctgccccctttcccggtctgtccttcccacatccctccctccccaaacagaaagaaagagagacaggacttctaatttggccagcacagacccgaatgtctttatgaaacccatttagtgaaagaaagaggggagaaatatattctgggttgatccgaactaaaaaatgcatggggctttggagatggggcgggattttttctttctttctttctgtctcttaagagcagaacaacagtttcgttgatgagttgcaaatggaaggaagtggacctctcaattagagattcccatttaagagcctcaatgtaaacctccctgtgacatccttaaaagatgctgctaatgtccctgggaccaaaaggtattaaacagcaagccaccaggcggcttcctattccttttctttttctgggggctttggtcgtctttttcaaattagctaaaattcattaaaggacccaaaaggaaaaatttaaagcagctgaattaaaatgagtctttccctgttagcctgacaagaagaaaaaaagaaaggaagaaagggaaagaaagagaagaaagaaccaattcccctccactaccacttcttgggttttaatatgaattattccatacaagtccctaggctagaggatctatttaaagacgcctggcagcatgaagggagagggtaaaaatacaaccactcttttgtccatcaaaggttttctttgggaggacattaagagcattcctgttttcttgtctgcccctgccagtggcaatgttccagctggtagtatccactcctcgcccatcaggtcagcaatcatgaacttctgtgtttaatttcaggagaaaacaaagggtgggaaatccttccgaaacccctatgtgtgtgcagcagggcaggggaggctggaactggaatcagtactctcttggctgtgcaggttgcatgctgcaaattcacacacccacacagttgagttgttgaggaagattgtgccgatggcattatttctgatgccagcttcccttgcatctgcaaagcttttttcttgtgtctctggcagtcatttgcttgtcaccattcatgtgcactgtccccttcatcagaggttctcagagcctgatggtcaaggatatgtcactagagtcttacccccagacccattttcaacagtaagaacgtgaaaccctggatggggtttgcaatctgaagcaactactttcttgttaggaagagtgctgactcagaaaattcaaagaatgggtaacttccgttggcgacatatccccagtgctcataatcaggaattcatccagttggggtccatttcaccctcatggcaaaatctggacataaacattgactagtagctttaaactgggtataagatttgcaacagataacatttttgtcttttcttttttcttttttttttccacaaaagctaagaatttttcagacaatttgctctcttccaaggcctggatcaatcccaactttttcttttaagccatgatccaaccaattgcagtatcctttaaaaatgaaagggcaacaggctaagacattcaagaaagttgataagctgtcagaaaatgctcaagggtggcctttctacagtgccacaaaccaacaacagccctaaacgtggagtcctcttccatcctttcatcagtagggaataaaaatagggagagagcaggtcaggggagaagtaacaaaagagaagtaagaaggattatttttgatgttcaaaatctgctgctgccctttcaatattttcaaatatcacaatttcagaaagggaaggatccctttatttcacccactctccctcccaggaaggtgtttgaagttgctgtctttacctgaaaaggaggtcaactcctcaagtgaaaaaacatcccctatcttcaactcgaagtaaaatggaggtacacacatttgtacctaattatgtgggtacaaatataatttgtatccacaaactataaaggatgtaaagaatcaaagaaatccaatccttaatcaaagtccaatttttctttaaaacttgagaggatattttagggctcattgcattgctgtgatttcactgccccccaccaaattatgaaaaattactccttttcagaatttaaatttttcttttgagatgtggaatccaaaggcagcagaatagtattgttacagggaagctggcagtcaaaagacatagacatagctgcagcatgcatggtttaagcaaatcaagacaagcagaaaaccaccaccccaacaagttcagggttatcagcaatatagggacacgtatttttatgtgatttttatgagaaccttgcccctttgacatatgtctgagtctaggagcattccggattgcaacgggattgaattcagtattcaaatcccaccattgggcagaaaaggcaaattgaatggggaatggaaagactgagttgctcctattgtttatgccccattcctaactaagggctctacagctgttaggtgagatcactacccaccattccaaagtgttgttgcgggtgaggaggttcaaacgcagctttggaaacactttgctgcactctttgaagaaaggccaacatgctcatttggctctagggtaaaagagagcctgtaccctgagctaacattggtcacctctcctcctgaggccataccacagccagcagtacagcagcagaacaagtgtttagttgtttcagcacaggtatccccagaacacctggcaccttttcttttccacagggagaatgtacattcatgcattttggcaagactgagtcctctgagttgggtgtctcggaactctcctattttccttctaaagggtcttatgtaaggtgagcagtagagtgtgtctcattcctcataaaaaatccccttcctgggagggagtgggtgaaatgaagggatccttccctgactgaaattgtgctatttgaaaaaattgaaagggcagtggcagattttgaacttcaaaatgaatccttcctcctcctcctcctcttttgttacttctcccatgacctgctctctccctactttaattccccattgaagaaaggatagaagaggactctgtgtttagggctactgttgatttgtggcactatagaaaggccacccctaagcattttctgacagctcatccccatctcagtcacagcttttatttgggtagctggatttacagaaataatcaaatccctagaggaaaagacttcaacagaaaagtacctcctgacacttgggtaacctgacttggtcatttccaatttatgcaagatttgtattctaaaagtcaattagttatgtcaactgttaaaaactcagaatgagtctttccattcttcagaatgactcttttctgattatctgtgggccatagaagcccacagatactcagcacaggatccaagtgccataccaagtggtcaactcttttagacgtaagtctcagcccagggcttctggaatgtacctcccctagcagagaagctctgtagtagatactttaccaagcacagggcctcgctcttgaccccaagactactgattctacttgcagagaagacaacttttctaatcaatctttctcttctatcctgaaccagagtatcagagattgtcccattagggcacgaggatctgtggctcaagctcagttaagaaataagcgtctttcaaaagaaaggtgcaagagggtggaactcagcctatattgtcattatcaaatgcaagaagtctaatcctagcatgatttattaatattagcctttcttctctccccgtttatgctttggtgggtactggacagaaaccccacaaattttaagacagttttaagagaaatagtaactggttaaatatcctcactacttcaaattattattattattattgatattactgttaacttttgtttttttgagacagggtctcactctgatgcccaggctggagtgcagtgatgcgatcacagcccactgtaggctcaaccacccatgctcaggtgatcctcccacctcaacctcccaagtagctgggatgacaagcgtgtaccaccatgcctggctagtatttttttattatttttgtagagatgaagtctccctgtgttacccaggatgatcttgaactcctgggcttaagtgatcctcccaacactgccttctaaagtgctgggtttacaggcatgagccgctgcacttggcccacttcctatgattaacaggatattattaatttagaaactatttagtacatggcaagcactcagtcaaatggttattaacggctgtttttatttcaggccaccaatatagcttcatcaaggggcaaatacttatagcttgggcttcagtgttggatcagacaccaccttagaagttttttgcaatcattaactccttaagtaagaagggaactctttttgtaggattgctttggggaatatgtagccccaaggcaggggctgtactctgagaagcttgggtagagttggagactgttagaaatggatagacacataaaagcatttagaccaatctgttcattttgcagatgaggaaattgagtcctagaaaaggcaagtgacttgttcaagatcacacagccaatgatgggagggtaggactcagggcttgaggatcagtttcagaatgcagtgaaattgttatcccatatttctttcaaatcagtatagggacacggaacactaacaacataggcgaccaatgggtctagggaggaaaagatgaaagctgtaggtaagtgggagtttggataacaatgagatgtttttctggagttcctgacaatgcctgaaaaaaaaagtcaggattttaagcttcagtcaggctcaaggtcgagtcctcccactccagtccctcctcagacagtaaaacttttcaagccaaggacatacatataggtgggggcatttgacagttggctcatctccccaccctccaaattatttatatttctagtccttcagtttagcactcctatttaccccaggattgtaattcattgcctctttccctggccatattcctccatcctttttgtttctcccatctcttttcttcctccatcacccccactgctgagcttggctacacttggctagtagtgcaggttgggagaacacagagtcctatcacagactggaggactattatttaatcacaagaatgttgtcttttttctcctaaggtagcactctggggacggtcattgctgtctttattccctcacccccccaccacccctgcactggattagacacatgaaatgtgcctatctctgagatgaaaggagcaagaactgcttcctccccactgaccttttgcctgcccatccttggagatacctggagttggcaggctggaggcctagcagcatttgcagtcagtgccgctgcctctgggtcagcccaggcttggctccttggctgctactgatgtgctgccagctaggaatattaaaaaccattcattgaacgcacaggatgctttataaaatccaacatgctgtttacagtttataaattaactgccttgggaagaggcatttgacttattctccaaggcatctagttgactagatccaattggaatcctttgagttcctgggaaggggctacttaacacttcacactttctaaattagacctagagtttcttgcttttctgatcctagtactgtatgaagttttatctagggttatctagcaagctttcttccacttataaatctttgatgtttttgcaatttctttgatagaggctttatgttctactatcttcactttatttatgcttcataccataattttttaaaaaattacaataaatatcaagtaattctggctgatatactgactccattccaaggtcattatattttatttgcttaacttggtcttcttagaaatgatgcaatgaatactggatacaaattagatgttcagagagtttatcaatgtgtctaaaaaccatccaggaaaacaacaggccaagactctgcctgcagagtcagtgagctagaagagggatcgaggataggaactatatttttcccctgaccctatctcttatctgctagagcaaaaggagacacacagtaggtgctcaataaatacatgttaaaaaatatttgttgaaagaagccacagaagggaatatcagtatacattagtattgaaaacagcctagggggaaatatggatactgaagcaccaccctcctgtgcctggcaagcaaggcaagaataaggccattcttggcacataccacttagcctgttgctgagataacttgcgtgaaaccagcactttaccctctgccagccagaaggtcagcccaagagtgagctgatctgtgggcacaacaccatctctcacccaggaggctgggcccgctgtaagctctgctatattatttccctgaggatgacaggtggggaaatctgggcaccagttgttcttttccactggtatcatttggaaggtagctccaaagtcgggcacgccagcctacgtgcctctcctgccggcagaggctccacattggagctattagaatgtgggctctgtacgtcggccaagtccatgtctcagagactgtatccagagcatagcgtggccacagggctactgagttcagcaagagagtcattctcttgttcaatccattattgcctgggccaaggttctaagtcttcgtaggcagcatttgattttatgacacgtcttaaaaaattaaggcaaactggaattaatttagttttgagaaaacaacagaagctgctacaaggcagagataattctaggctgccagaaagtggtgatctcagtggtgtacattttcttaattcctgattttcctctttgtgaggtcttcctcccactcccatactttgcacattctcacctatgcacaccctgagcaacacaatgttgacaacttgacttagcattgctcttttcttaagctttgttttcatttcttcttcaatacaacagtgttggttcattcaatttgaacactcaaggcaaaaaaaaaaaaaaaaatcccaggttatgttttcagaatcttacctttttgtttttgttttgagggttctgtgagttttgtggcatatttacattgttgcttacattcttatttcagaatttaagataaaaactgggcaacaactctcacgttttctgagtgtgttgaaatgaaaaatctgtttcttagaattaatggtaaagcaacatttcctgtcaatctttcattctttaatattacttctgggttcagctcaccatctctaaagagaaagccagatgatcaagttacattgtatgtgacattaactatctctttatctgtgtaaatgtcataatatctgcttgcaaagtgttttattcatttttaggaaaaaattttaaactgtgcttgcaattcaggatggtgctactaggtggcagtaatgtacaagaactatgtggtcgccctggaagagtatttgactaagagactagcatgccttcccgtaattataagaaataaaaatataatatttttaaaatactcaaactggcacaaacagtaaacatccattaacttagttaccatatttaagctgagcttttaaaagagaaagccttattttttaatgaaattttaaataaagtatacattcacaagctcaaaaatctaaaaatacgaaaagatatatagtgaaaagtctttctctcatgcctgtccctcaactaccacaggtaactaattttgttagtttcttgggtatcctttcagagctttgctatacaaatatgtgtttttatctctctccattttaactcaaatcaatacatagagtttctgcatccttccatatatagttggttagtatattgttgtgtgaacattttagaatataattaaccagtcccctattaatggatatttcatgctgtttccaattttatgctatttcagccatgtgctcatgtgatttcacatgtaggataattcacagaagtggaattgctgggtctaaattatatacatttgcatttttaaaaggtattgccagattggcctctacagagtttggaccaatttatactgaactttctccaaaatggacttgttttcccacagccttgccaatagggtgcatgatcagacttcggaatctttgtaaatctgattggttgaacaatgtatttcaaagtactttaattttcattctcttaaatgagacttttattctcttaaattctcttctatctttaagggccctttatatttcctttttctgtggagaaagtggaaatgccaataaatacaacgatgcatacacatgtatagggttttgttattgatgtagcttgtttttgccatcatgctgtacatgatgttctttaatttgctttgctcatttaaccatacctcctggccatggctctgaagagaagttgctggcagtgcagaagaagggccaggactggaatgtctgcttctctcttcatccttttgccattgactcctgggggaaatatctgtagaccgaagcagtgaaatctaatcaattctctttctgacactaattaaggcttcaaagagacagataaccacttgggataatttagtcacagtgaaacttgggaaatggtcagtaatatttcatcctctgaaagtggaccccaagaaagttctggctctttgagttgttgtcttggtaattttcagggtaacgtgtataggaaaacccagattatgcagatgaaaagaaaacaaacatgctcttctgcatcctttgcagatttgaaactttgggcacaggtttgatttatttcaatgagatgttgctattagcatgaacataaagtggtgcaaagttgtgctggaatatggtctcgtcaactttgggctcactgtctgcatatggagatgatagtaactgaatccatagttatcaagtggtggcattttagaacacaaagggacagcagatgccatctctgtcaactccttccctctacagatgaggaaacttgggctagaggaggttgaatgacttgtgtaaggcttccccagctaattaatggcagtgccaggactcaagtccaggtgggttccctcattactggtccttgcccttcctgcaatttataggacttccctgaggcacatgtgctgaggctttgctattgccagggattctgtgctctgaaacagccctatctcacacacccctttccacttaggatcccctacctcacacttccaagacagctaattgaggctaaatgggtctgatgccattctattagtgcaaaataaattggcttatgccaacttgaactcctaatcttgattttatcaacactttgccctgtttattcagactgttcatgagtaggaagttaaggaaaatgttgcctatgaacaaaatgatcaaacttttatctgaaatacctttgaaagttttcccgaagctttaattatcatgttccttttgttttggatgtaatagcaggccctcccaattttcctaaatgtttgaaaatatttttgatactttctgtcttctgttgtggttaaaaaaaagaaggcaccagtgttggctatgcctggggagttagtgaggtaatctggagagatctctggaccccagtcctttgtccaagaggtatggtcaaaagaacaaagcaaatttcagaaaaaccggtataatatgatcctattttaatggtaagtctgttccaacaactgctttctttttcgaattacaccatgtgcccaggctacaaaggctctgcagaaatgtgactctgttggcaaatacgcgtgtgataccttaaccatgctggaggccagttagcataatgtgtatttcagatgcagtttgtcatcagtgctgggtgctatggggcttaaaacaaaaacaggatgagcctagagcacagaagtggaaaattaggtgggtgggtgagtatggacttggaaatggaaaatgtgcttccctgtgggacatggcttgtgttcattagtgctgacctgcctcctctctagccctgtaagctgacgctgacaccaaagcttgctgagaaactgaatagaccctcccgccccgaccaaccaaggacaaagatgagaccacccaattcggttacgttgttgccagaacaacatgtttaatctttaacatgggttcaaactattcttggccctaggaacatggacttcagcaattaaagtcaacatgtgcttccattaaaccattgtgtccacctccaaatggttataaatatgtagcataagctatgggagttggggtggaatggatgacagcctttgctaatgacgctctagaaaccaatattctcctctcaaaataacatggaaaaattctacttaatacctcctgggttccattagtggttctgggtaaataattctggggaaagtaatttctgttttcattccagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaaggtaagaccaaggtctctgtgaggagagcatttccctcagaaacaggcaagaagccatatttctttgtcaggggatggagaactaagatcatagcccaaacttaagtgatgtggctggcccacagggcttgtgggagaatgaggcttttagaatttccccccgtgctttgcactgttatcagtaaaagtgcctaatcaatcatgtgcacacccatccagtgggacaggtgtcctttgtccctggctgtgatgtttatgagtggtagtgtgcttttccaaaaaagaaaaatggagtttacaagtcatcataactctctagctccatcatcaataaagaggaagagaatgcaaagaatgcgattgagcagtggaacatacttcttggagggctctttaaagagattcttggtgaaataactggctttgtggtctgagcctttcttcaggtgctacatttctgttcaaatgatttcaaaagataagatggcaatatgatcatttatcatttttacattgcttatccaaatcgttctcatttggaaaaggatgcatgtttcttgcagaggcagtccgtgcctcagtggtgtgcaagggaatatcatgcttaaaaggccaccaagagtggccagctacatggaccacccagaagggaggcacattgtagggtggaacatacgagatctcacgactgtcactgcccctaaacaggcacaatgaatgaaatttgtccacacttggtaaataataatttgtttagcccaacctcagagatttttacatttagttttgagatgaaaatcacttaaacattctcgtatggcaagtaatttttgaaattaccagtataattaagaattttttatagtatcaatcaccagaattaagaccatataagccaatccctccactctccattcaaaaacattatgacttttgtatgccttgaaaatttccattaatttctctgattatagctcagtgatgatgattcattttagtttaggaggatcagaattcgagttaaatcattttaaccattatattaataagatctatgactgtgggaaaaaatagagattttccacttaataaaaactttctggctcttatttgtgcttgtagaaccaaaaaaaaatggagtaaatagatgaacataaatttttgcagggccacaattccttcttaggaaagggaaactaaaacaaattgagaaaaaacatgagaagtgcttttacaagtgtgattgctcagaaattgtgggcccatgtaaggttgactgcagcaattattagtttctccttccctcccccttcagaaacagacagcatgaatatttagtgattttattccatggataatttctttccgtattgagttgtcctccataatcgtgattcttttttaaaaaaaggaattaaaattatttcaaagaaagtgtcactatgatgatagaaaggaacaaagaaataggagcatctataaaaactagaaaacaatctggaaagactggacaaaatgatggaggagtactttggcaacaatcacattaatctagcgaaggtcaaagaagagacatcatgaactcaaaccgaagaaattcacatgtgaattctgagcatgagtcttagaaacagactttagtgtactgttattcacctttgtttcttccagaaagccatggcaaataacagcgcaaaattgtgatagcaggagaaatgtttgtaatttcatgggaacaatctgttttcaaacatcccaaactatcccaaatatagcaatagttttatgtaaatggtgcttgcaattataaacctttcttccctggccataaaatatgcctggcaaaatctcaactacccagaccttttctaggttagatttttctctatgtatccaggagcaaaactgttttcatttggaaatgttctataattcttaactcttacattctcgggctgatcttttctctaatgggtctcacttaatgaaattgtttgcctttagagacttggataaaacatttagcctatgtctagaaaagaggcaacaacaatctaccctagcttctttttacaaagaaaagactgggatagatttttttgtctctataaaaattatcccttgacatcatgttcaagggtcattatttattaaacatgtgcctactgtttgcctgccaattgttaatgctttctgactcacatttatccattatctggccttgtaaaggcaagaaagggagaatgtgacccaggctcagggaagggagtgtacctgcttgaacacctaatatatgtgtcaggcacctcatattgtatattataatcattgccaagaaacctgtgatggcaggcattattattcccattatcctggtaaggaaaactgaagcccaaaataattagattgcttgatatcatatagccagggagtggcaatgtctgccttacagcattcatcttcccactacttggatcttcatattggaggaacacaagtagaatgtaggagccatcacatagaagttcaggctctgcttctgatctgctggcagtaataatttatactcagcaatgtttctagaaaaaataaataatagtgaaagcctttctgggagctttcaatgagactgttcatcccagccctgaacttgcagctggccagtcctaggtccctgctgcccatctcctagcaattccggaaaggactgagagggagtcaggcagaaaagactggccacagtggcccaccaaagaggacagtgtggccacagattaggatgtgcctgatagttttaagtggtggcacctcctgggtttgggtacaaaagatcctgggagtagcaggttcatttataatcttcatggaagactaagtttctctaaaatttggagtaaaggctgtagagcaaacaggcaaaagaccagttgatagtggaaacagactgcctggtggaatctctatgagaactgaggcatgccaggctttgaagtgagagagacctggtttccaattccagctccatggcttgccgaatgagtgactttgaggaagttcagtaacttccttctttgtgcctcagtttcttcccatgcaaaatagagctgtctacctgagggtatgggtatgggtgttggtgatttgtaaagcatccagcggtgtccagcacataatagccatttaatagaagatattatgatcttgatgataaagttataaactaagcaggtgtttagactcaattttctatttcagtcacaactgagatctcaataactgctgggatctcctatagccttaaaagattaggaaaatgaaccttattgtagttcttgttaagcacagggtggggcagaagagcaaagtaaatgtaagccactgtgctgggtgctaacagggaggataaaagtaaaagagaaacagccccgatatctgtctaaccttccttcccagatgagtggaggaaggaggggctggagggggatgagttttggacttgggccagggaggggatttcaggaatggagggtgggaaagcaaactggcagggaagacctggaaagtctcagttgggtgaggagtgggggatgctggccccaggccagggcatggaaccagggcatgactatctgaaccggtaagggccacaggagcaggtggggaactggaagagcaacaacaaaggataaggaggaagaggtttgggagacaaaacctaggaaaagaggacctggtatgctaagggctgagtcctaacagcttcctaacaggacccccaagccatcttctactgctacccaccaagctcatggtgtgataggagaaatggagggagtcaggaaaattgtgtttataatacaatagacttcttgagagatataatttgatttttttaaaaggaacaaatttatactgagtgcctaccatgtccaggtgctgtggaaggtgctggagactctaaagtggaaagaaagaaaaaagagacaatttttttgccttcatgatgcttacaagaaaatggggagagagggaggaggggtgttctgtgcacaaagatcagtttgtatctgtttgattcatgaccggagtgaagggaccagtttctagttggagtgagctgagttcccatccaccctttcaaagcccccaccatctctctgctgctttgttccctggttgcaattttcttggtgccctcagcctagcacagatcttttggaggttgacctgggtccctgaagatgagcggagttatgaggctgcccgtggggaaagaatgggagaagaagcatgggtgaatcttgttcctgaggttatagagggtgtttcaagaggtgccatggaaataagggtgcatagtgttcactgctgcgaaaaaggcaaaatacttttccactctgtcggagtaaaatcgcaaaaatgctcttctagggtgggacaggtgggtctttattctgatgctaatggtgacatctggtcagtcaaggctcttggaagattcagctctgcataagcttggggatggtgaagctaatgtcccaagaagcccacaagaaaaagttagacttgtatgtctatggatatggtcaggggtttctgaggcaaatcaatgtagataaggaagtctgtgagttggcatatgcttgaggaaaacatggtatcaggaggcaggtattatactggtttaggtcagggctttggtttcagatagaccttggtttgattccagctctgcattttaccacctatgtgagtttgggcaagttactggaactctctaaagcttgagtttccttatctgtcctaatagtgtagatcataacagtactttcttgtagggttgttgtaaggatgaaataactcacattgcaagtgctcaataaatgttcttattagcgaaatgatggttatctagtgattcatctagagcacagccctcaaacttgaatgggtccagagacctgctactcaaagtgtgggcaccagcccagtaggactgacatcaactggaatctgatgggaaatgcagaatctcaggctctaggccagaactactcaatcagaacttgccttttaacaagatcctagatgattcacacgcacattccagtctgagaagctctgatccggaagagatcaggagatgttcaagtgctgaaacacaagtaaggcatggcagaagctaaaatgtgaagtattgagagtaaaccaggagagcagatggttattccttccatcccttaaggatcttatctttcaaacttctgctttaccacttcaacacacaaaacagagatagatttccttctaggagtgtgtgtgtgtgtgtgtgtgtgtgtgtgtgttgagaacatcaatggttcaataattgcttcatagtcttttcttccaggaaagagcatttgaatttggctacagagaatagataggtgggattttattaggcagagcaaggtggaaaggacatatttgggagacagaagacataagcaaaggcaagaggcaggagaattcagggcactttcttggactcctaagtagttaagtttgactggagtagggagtgggtagtagagtgatgagaatagttgtaagtaagactggaaatacatgtgaaacctgggtcatgaagggccttgactcctcttcaagattttggattttattctgaactactgaaggcatttattgtacatgtctgtgcattcttcttgcacaaacagtccagctcccaaggaagaggggcccagcccattggaggtggccccacgtccttcagtgcctggagttcttgtccttcagagtgggctgggggtggagctggacatcctgaaaacttttagtgagattgcaatcagatgagctcatttacaaatggccctacgctgttgacttggtcattttatggacagtgctaatggcccagtcagttaggcctacgtttggttcacctgtgtatacatcacttggatattatgtcccatatcattgttggcccttctgagttaagttcgttggcacagatttactttgtccacccagactgaaactgcacctctgaagactccatcacggaaggtgactctgtgaataactgcttagtcaacctaatagatgatctagatgagagattagcaaatttaacactactccaaggtgaggtatcaagcagctcttcccacatacagggagatggggggagaacagactaaggaagatcttggactctctctctcattagagaaatgggggtgggaattagggactagcctgtgtactactgacctatggcatagtctctcaaaacccatttcagagccaggcacagtggtacatgcctgtagtcctggctacacaggaggctgaggcaggaggatcccttgagctcaggagtttaaggctgtagtgtgctatgatcatgcctgtgaataaccactgcactgcagcctggacaacatagcaagactctgtctctaaaaacaaaacaaaacaaacaaacaatcatttctgatagtttactttgcctgtcaaaatgaagagcaggtaggatagaatcaaaagctttaaaaaaatcaaaacagcttacagctgctattttctctctgcctctgcgatcattcagagaaaataaattcactggtctagtccaacttattcttccctaagccctgctgttttttttttctagtatttcatattgccttggtggttgctaagtgattgttggatttagccccagtatattctcagataactatgccaataatctataattaccagaattcatcttttctcccttttggaaagatggactggctatttttttcttgtaaaccttgggtgtttaattctgccctacaggatgatgtcagagataatagctggtgagtctttaataataactgcgaattcctacaatattgtaaggtaaacgtcaaaaggtttcatgcatatatatgtatcttttaatctttcatttgaacagtttcactttttatgatcttgctgttggttctggaattataggacaaatttttcttttcttttcttttctttttgagacagggccttgctctgtcactcatgctggagtacagtggcttgatcatagcttcctgcagcctctaattcctgggttcaagtgatcctcctgcctcagctgccaaagtagctgggactacaggtgcacatcaccacgcctggttaactttttatttttttttttagagacacggtcatgctatgttgcccaggctggtctcaaactcctggggtcaagtgatcctcctgcctcagactccaaagtgttgggattataggcatgagacaatacacctggcccaggggatttttttctccatcacttaacatgaaattcaccaagcaaaacctcttacataaccatgggaccaataatctcagattctccattcccctccccaccttgatattaggattatgcagcttaatgagtcaagctgtcccaccctacccacctattactcccactcccaggataccaggagttttgtatgggatacataaatgatccttttttccattccgttaagctgtatgcaaattgtgtgtgtgcttatgtacatttttctggggataactttggtagttttcatcagattcttaaaggtgtctgtttgctaaagccagattaagagctactataaagaacacatagcctccgttattccagcccaatctttggaaatagagattatcagaatgggtacatcctaatatttgccgcaaatgactctgaagatgcggatgcaattacataaatcccaggctccttcaacatataaacccagaagtgtgatttcagggccccagacatgccctgtctctacttcattctcttgtcccaaattgcagcacccagaatatttcttcctaagcattactcaggctatcctattttcttattcagaaactatattcctgttctttagctatttcctgcacaaatcaatttcttttttttttttttttttttggtagtcattttaatttacttcttggtttcaatttggattgactttctgcattttgctactggtagaattgcaatgcattgggccagtggtagaccactacctgtcaggagaaatttcttttgttctttggtttttactcgcacatcacagtgatgggcgtcattcagtggttctaaaccctcagtacacttagaaatcacctaagaagctttgaaaaccatgaaagcctggtccctatctccaaggattttaattcaatcgatctgaatgaggcctgggtgttgacttaaaaaaaatgcaacatgcattgagccactggtctaatctagcaggaattggcaacgagtgtgagggtctttcaaaagatgctgttttacctggctaaggttgtggcatgcccacagagtaaccacctccttttctttccccagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccggg

SEQ ID NO: 3359 - DNA, 1589 bp, human
atggcagacgatattaatattgaagcaatgcttgaggctccttacaagtaggatgagaacaagttgagcagggccaacggccatgaagaacgtagcaaaaaaaggaaaaaaagcaagagcagaagtcgtagtcgtgaacgaaagagaagcaaaagtaaggaacggaagcaaagtacagatcgagaaaggaaaaagagcaaaagccgtgaaaggaagcgaagtcgaagcagagaggcgacggagccgctcaagaagtcgagattgaagatttagaggccgctacagaagtccttactgcggaccaaaatttaacagtgccatctgaggaaagactggattgccttatagtatcaaattaagcataggacgttcccgaagcaaaagtccactcagaaaagacaagagccctgtgagggaacctattgataatctaactcctgaggaaagagatgcaaggacagtcttctgtatgcagctggcggcaggaattcgaccaaaggatttggaagagtttttctctacagtaggaaaggctcgaggcgtgaggatgatttccgatagaaattcaagacattccaaaggaattgcttacgtggagttcgtgggtgttagttcagtgcctctaacaataggattaactggccaacgagttttaggagtgccaatcatagtacaggcatcacaggcagaaaaaaacagagctgcagccatggcaaacaatgtacaaaagggaagtgctggacctaagaggctttaggtggactcattacacttttaacataactgaagatacgcttcgtgggttctttgagcctttcggaaggattgaaagtatccagctgacgatagacagtgaaactggtcgatccaagggatatggatttattacattttctgattcagaatgtgccaaaaagtctttggaacaatttaatggatttgaactagcagggaggccaatgaaagttggtcatgttattgaacgtgctgatgcttcgagtactagttcatttttggacagtgatgaactggaaaggactagaattgatttgggaacaactggtcgtcttcagttagtggcaagacttgcagaggatacaggtttgcagattccaccagcagcacagcaagctctacaaatgagtggctctttggcatttggtgctgtggcagaattttcttttgttatggatttgcaaacaagactttcccagcagactgaagcttcagctttagctgcagctgcttctgttcagccacttgcaacacagtgtttccaactctctaacatgtttaaccctcaaacagaagaagttggatgggatacagagattaaggacgatgtgattgaggaatgtaataaacatggaggaattattcatatttatgttgacaaaaattcagctcagggcaatgtctatgtgaagtgctcatcaattgctgcagctattgctgctgtcaatgcattgcatggcaggtggtttgctggtaaaatgataacagcagcatatgtacctcttccaacttaccacaacctgtttcctgattctatgacagcaacacaactactggttccaagtagacgatga

SEQ ID NO: 3360 - DNA, 108292 bp, human
aacgtgggggccaaacaacacggccgggaggcgccgctgcctgccgggccctctcttctgggaccctggattttcggacactgagcgccatggccctgcctctgctgccgggcaacagcttcaaccgcaacgtgagtaggaagggcgtccgaggtcacagctcccggctggagtctggggtccaggcagggtcgtggcgtggccacctccgcagactctcctggaggccccatgctgctgccctgggttggtggcaacttggaccaaactttataggctgcttctcccatctctccagctgcatctgaatgtttttcctaatttagaaatatatagagagagtccttataggtggcaggaccctcaaaggtaacaaataatagtgacgataaccattgggggtttaatgtgtgccaggcgctgtgctttaatcaccttatgcagcatccagtgtcccaacagccctttgaattaggtagtttttattcccagttactattgaggaaactgaggcacagaaccacacagtctcagtggtgaagctgggtttctttcaagcaaccttgtctccacagctcaggagcctaatcattatccccagtatcctgtgtgaaaaaagataccgtttcaattatcaaattgaagaaatctggcacttatcaagaggggtaggtggcagataagagttctatcagcctgtaaagtttactcccaaactttatagagacaggcacccaaacttggagggattttttttttctctatttataattgggaggggttcatttctttttttttttttgagacggagtctcgctctgtcgcccaggctggagtgcagtgacccgatctcggctcactgcaacctccacctcccaggttcaagcgattctcctgcctcagcctcccgagtagctgggattacaggcgcccgccaccacaccggctaatttttgtatttttagtaaagatggggtttcaccatgttggccaggctggcctcggactcctgacctcaagtgatctgcccgcctcggtctcccaaagtgctgggattacaggctgagccactgcgcctgtcctggaggggttcatttcaaaagaagatgaacgtacagaacaaagcaacacaacacaaaaaaccctgagcatgaaagaacttttgccaataaatagcacctcatttaaacgacagcaggaaaatgattcaggcttttgtttatactggttactacccttcacttgggtcagccatctgtgtctgcaggagaagctaattcccaattagatgggagggaattagatggagccactcaaggcaattgtgtaaacctttgataactttagaaagcaggcagcagattgaagtatttggctttatggtttccaaacactgtctgtatctaagttgttggccctgaagtacaagttttttctttgtagcttcacgccattgaattctgacccctacacgtctggtcagtccaactttgaacactgatttgtgcatttcttggttgatgggcagaggctggccttccagcatagcattgccctttggtaagtttaagccagtcacgcaaacaagaaaggcccctgagagacgggacatgaaaacagattccagaagtaaagaagcatgctgtgtaaaagtaattttaataaaaaatgaaagtaaagcctacagctttttgcccagcaacactctgattaccagtgcctgcctcctgcagaagtatcatagctctcacgtgcagtgattaaggatgggaaggaaaaacagtggatggatgaaatattaataaatctgcaaggttctgcgtatatttttgctttttaaaaaactttaagatcatgaagtacaacacatatacagaaagatgcacaatggatgatcacaaaatgaatatcaagaaattaaatatgggggctgggcgcagtggctcacgcctgtaatcccagcactttgggaagcagagatgggaggatcccttgagcccaggagttcgagaccagcctgggcaatatagtaagacctcatctctacaaaagattgaaaaaattagccaagcgtggtggcacatgcctgtagtcccagctactcaggaggctgaggtgggagaatcatttgagcctgggaggtcgaggctgcagtgagccatgattgcattactgcactccagcctgggcaacagagccagaccctgtctcaaaaaaataaataaaataaaatatgacctgttctccaaaaataccacccttgactggggttgccagatttagcgaataaaaatacatatctcaaatactgcatggaacctgtttatgggaaaggattatttattgtttaccaaatttaactgagaatcttgtattttatgtgacaactctacctatgaacctttctgttcattaccccatctctactctccagatataaccactgttctggctcctatcactataattaggttttgcttgcctttgaaccttttatcaatggaaatgtttggtgtttattcttttgtgactggcttttttagctcaacagtatgttcgttagatttgtccatgtggctgtctatagaggtagtttgtacatttttattactctgtagtattgcattgtatgtttttcacatcatttatatatacattttactcttgataaatatttggcttgtttggggttgttaagaatagttttactgtgactatttttgttcatgttttttggtaggattgctagatcatacagtattcgtatgttcagctgtagtagatgctgtcaaagtgattatactacttaaattcccaacagcattttatgttcctgttgctccacattctttctaacacttggtattgttagtcttttaaattttagatattttggttggtgggtatagcaactctttgtagttataatctgtacttcctgattcctaatgaaattgagcatgttttacacgtttgttggtcatttgtatgaccatttattggtcactgcttttttttttagacggagtcttgctctgttgcccaggctggagtgcagtggtgcaatctcggctcactgcaacctccgccttctggcttcaagcgattctcctgcctcagcctcccgagtagctggaattacaggcatgcgccatcatgcctggctaatttttttttttttaatttttagtagagacggggtttcaccatgttggccaggctggtcttgaactcctgacttcaggcgatccgcccgcctcagcctcccaaagtgctgggattacaggcgtgagccaccgtgcctggctttatttgtatgaccatttattggtcactacttttttgtgtagtacttacttatctcttgtctaatgtttactgggttgtctgcctatttcttagtgatttgtagaagttctatataaattttgggtatcttcttgtctgtgattggccttttccttctcttaatgatgtttttgatgaataatttttggaaaagatcactctttctccatgtctctgcagagccactttgtcaaaaatcaagcatccagctacgtgtgggtctatttctagactcatgaatatttaaaacatttatttactttatgcctgagaacaatgggagtgtgtgcgtgcatgtgtgtatgtgcgtgtgtactagagaatgacagtaccttggactcattcaacaaatcagtatttatttattgagtatcctagtatatgccaaaattaggtgactacatttaaaaaattgttacactagccttggtactaaatgtactgtgtgttgcccacaaattaatattttaaaaacttgtacttagttaaaagattggatgttctctggcatagaatggttagaaagtcagtaaagccatatctggccttttagtcttgcccttcccccctcccctgcttgctgaattaaattaccaagtgaaaaaccttggcctcctgtagatagcataattacttggctgtttggatttaaaattataacacagctaacttttattgcttttccatagaattgaaaaggaacttatgtgccccttacttagctgccagtggtcagtcaaaagcaatagattgatttctgtccacggctaggtgatacgcaacctgtatttctctctctcaaatacaagaagtatggtgccttctaaaatatgaacatttgtacctctgatgacattacaattattttgatatgagttgaaaaccttagggaaatatcacaactaaattctagatacactgtatcttttttccaacaatttccatgctgaacttgtattgagcaagagaatcttgggcatattatcaaaattgaaaatattaaaattaaaagggacatttccagccaaagccaaaaatcctttctgcagtattttggacagatggttgtgtggcccatcctgatcctgagtgtctctaatgaatgatgaagagctcactctttctgctttttttttttggagatggagtctcgctctgtcacccaggctggagcgcaatggcgccatctcggctcactgcaacctctgcctcccaggttcaatcgattctcctgcctcagcctcctgagtagctgggattacaggtgtgtgccaccacgcctggctaatttttgtattttgagtagaattggggttttaccatgttgatcaggctggtctcgaactcctgacctcagttgatccacccgcctcagcctcccaaagtgctgggattacaggcgtgagccaccgcgcctggccgctctttctgcttttaatgaagctaccttgccaccatcttaggagggtttgctgtaaatagcccatcatctaatttgtagtgaagcaaagtcctccttaagaaaaaagaaaacatatttgaatttgcagcaataaaaaaaaaaggaatttaatgaatcatgaccagctttttttttttttgaaaaggaaaaaagaaaaagaagagagtggggtagaatgaagaattagagtgtattatgcttgagaggagttaagtgttgcacggacctttttgtccttcctgtgtgtgcttgtgtatgtatgtgaactggcctgcactaaaatatgcctattactgtggttgtgcaatcagtgtttgaaaaacactcattcgagccatctccatctttttttttttgcgatagggtcttgctctttctcccaggctggggtgcagtggcaggatcacagctcacagttcactgcacgcagcctcaacctctcgggctcaagacatcctcccacctctgttgccacagtagctaggactacagacatgcaccaccatacccagctaattttttaaattattatttgtagagatgcggtctcactgtattgtccagactgggcaattcttatttaaatttagatcttcagcttctttcaaggtcagatctcatctctcacccttcaaagagccttgtcagcctttcttaatgtatatttttaaattttttgaggtaaatttcatgtaacatgaaattaaccactaactatttaaaagtatacaattcagtggtacttggtacattcacactgttgtgcaacaactaacacctctaactagtttcagaacattttcatcacctcaaatctcaatcttttcaccctggaggagtctttgaaatgattttgaggtcttagagaactcctgcataaaaactatatctatagcccatggtacattagcacaatctgtgataataaatatgtaattacataaaaagatgttcaacattatagctattagggaaataagaattaaaatcaagatgagataccactgtatacctattaaaatggctaaaatccaaaacacaataccaattgctcacatggatttgaaataacaggaattctcactcattgctggtgggaatgcgaaatggtaatttcttataaagttaaacacacacctgccatatggccagttccgaatttatgtgaaataaataaattcccataaataattctgggttaaactcaaaataagcacatatcaatttcattttcaactggaatgagaatattgtagctataataatccaataataattgtctttttaaagtaaaaaatggtagttttctgtggatctcttgatttcagccaacttatttacctactctttccctttctcacaaagggttatcaaccctaaagcaagtgggaatgtagaagaggaaacttcaggttgttttatggtaaaattttctacttgatttatttttcctttttaccttatccaagtaggcctaaaagttctctatagtttctattatagagggtgctattgaggaatgatatatggtatatggtatgaacaaaagtagttttctcccctattaaaaactgaaaaggactttttaccagcttttttgagggaaaaaaaacccaaaacagatagttaaacttagcttacctttctttcctttccatacattcaaaaaacttttcagtcagcataatataaacatgttaaataattcaagttatttctgtttatatctaagatggaatttactttttcaaaaagtaggctaagatgatttaatttaaataaaggttgtaaactcgtaattaatgctgttttcaacatcaaaatgtattgacaatgttacataataaagctactaaaactatatgacaaagcattatgagtaaaaatataacctaagatataattttatacaagacttaaaaattaggttcttttactgactgacatgattgggcttaaatataggcagttacaaaattataatcttgatttctttatagacctgtatgtacataacagtcttattttttaaaagctaaaaataaataataaaatttacctctccactctgaaatctgtgtttatattttgccacataaataattccgggtcaagcttgaaataagcacacatcaatttcattttcaactggaatgagaagatttctggccttttcaatacttgttaaacaaggaaagctttgcttacatgtataagaagttgaaaattatagcaaaatggtcattgctctcctatgaatggcaggatgcttacttttatgtaaattttgaactggccatatggtaggtgtgtgtttatcttgataagaaattaccattttgcattcccaccagcaatgattgagaatttctgttattccaaatccttgtaagcaattggtattgccagtgttttggattttagccattttaataggtgtatagtggtatctcctcttttctctctctctcttttttttttttgagactgagtctcactctgtcgcccaggggagtgtagtggcgcgatcttggctcactgcaaccctctgcctcccagttcaagctattcttctgcctcagcctcccgagtagctgagattacaggtgtgtgccaccacgcccggctaatttttgtattttgggtagagacggggtttcaccatgttggccaggctggtcttgaactcctgacctcaggtgatccacccacctcggcctcccaaagtgctgagattacaggcctgagccaccacacccggcctggtatctcctcttgattttaatttttatttccctaatggctatgatgttgaacatctttttatgtgcttatttgccatccgtatatcccctttggtgaaatgtctgttcgtgtcttctactcatatttaattggggagtttccttacttgaattcctgacctcaggcgatccgcctgatgagttttgaaagtcatttttaatatagtctggatacaagttgggtgcaagtctattattgaatgtatggtctgtaaatattttgttccagtctatggcttgaattttcattctcttaaagcaaggctaaaaaatatgtacatatatttaaggataaaatataacatgagttcaaaaactattgttttcaatgcaaattaaggattatagggtttttacttctttgattttatatatttacatgtaatcttgcttcataagtacattagctgaattacttatcctaacataaataaaaatatacaaccatataataatttttaattaataataacattattaacaatttgagttttgaaaatagtttaagatttctttatagctatttctgttgtgagagtatatcccaccaggaatgtatagtcaaattactgggttttagtttcatttaaatcattgctgtcggtatggttaagtcaccaactcagtatctagttaggttcatttgtttcattgtgcttttgtttctgaacttaaaaaaaggcatttgtatggtctcaaagtcaaatttgcaaagtaagttactttcagagagctctagcttttatctctgtctcttcaatcttattctctccctctctccataataacttaaagaaaaaactttatttagtttgaggttatcctctttctcttcctccttctcttctttcttttttttttaatttttaaaacagcaaattgttaaatttattcacatgttccccttttattcaatacttggtagcataatctacacagtcttttgaaccttccttttttcattttaacagtatatcttggagatcacttggtagtggtatatagggctcttcctcatttctttttatagttacatagtactccattttgtagacttacaatagtttattcaaccatccccttttggtgtacagttacattatttccagtcttttgttatccaataatgttgcaataaatagccaaactgtgcttcaaaagacactatcagaaaagtgaaaaagcagctgacagtgtgggaggaaatatttataaagcatattatctgataagggactatattcagaatatgtaaataactcccaaaactcaataataaaaagacaaataggccaggtgcggtggctcatgcctgtaatcccagcactttgggaggctgaggcaggcggatcacctgaggtcaggagtttgagaccagcctgactaacatggagaaacctgtctctactaaaaatacaaaactagccgggcgtggtggcgcatgcctgtaatcccagctactcgggaggctgagacaggagaatcacttgaacctgggaggcagaggttgtggtgagccgagatcgcaccattgcactccagcctgggcaacaagagtgcaacttcatttcaaaaagccaacaaacaaacaaaaaggcaaataatccagttttggtggtatgggattgctgggcagacaaaacaattgctgtctactatgctagatcacaggatagttttgatataaagaattctgtcactttgttcccagtaactattaaaatatccttgaaattacattatttcagattgggccgcttattgaagctgccatccatactttggaaataacatattccattgctattcctaaatgttcatttgaatttcaggaattagagtctctttgcctatgtaggattcaaacacctaattttggtcaccatgcattctgtactgaacttcgtagctctgtcacctagggtacatttgactataagtcacagaatacctgactaacagtggtttaagccaaattaattttctcataagaactttagaggtgtagcagtttcagatttaggcagtgactgatgaatgtcataaagaacccaggctctttttatctctgcattctgccatcttcagaatattggcttttctttcttaggcttgtgacctcatagttgcaaaatagttgcctcagttccagtcatcacaactacatgtaaccatgttcaagacaagcaggaaggagagggaggggaaacagctcttcttatatgagaaaacaaaatgttttccaggagccccccagtagattccctccttccatcttatttgctaaaattgatgcacatggccatcctttactacaaggaatgctgggaaattatcttgttttttttttcaccatctacttttggaggtgggaaagggaaaagagggttcaatagtggccaacaaactttgtcacaccagccacagacaatacctgtgagtctggtattgtcagacttagtagtatccctttcattacaatttgtgtttttaaattatacaagtaacacatgagtatatcaatattgcgaaggataccaagaatactgttctttgtaaactatcttcttttccataatgggaaacaagcctaatactccagttaatccagcatgttcactgtttgtcctttgggtatattttggacttttccactcaattattagtttgtttgtccccttgcctgatagcagcatcctcatgcctcttcctcttcccatctagatcctgaccttccctcaaaacttggctttaatcccccctcctcattaaagccttccccgatcatctcagcaagaaccatctgtctacataagcttgcatgctcatattgcccatttaccgccttatttcctgcgttgtgttttgtgttctttatgtgtgatcgtggcagtcctcagttgactaagaaactgtgattggtggctctttgggttgcccttcacgttctcagtgccttccttacacaaaccgggtccttaataggtgattgtccattgctgcctctacctgcagcaaccatggttgaaacatagatggaaataaacacagcttgggggaatcttctctggaattagtttcctgcttatgtcttccgctgctgctgtggaacaaaatagttcttgttttagcaatagtgaatataaaggatgaagaaagtcatttgcttttgtggcttaaataggagataagtctctcgggatacatggtttatacacagcagccagggcaatatgaagatgtccctatctaaattgtgacacaaagcctctctgtggcctcttgcaccatgctgagggatagttttctctctcttattggcatccagtttgggttttcctggaagcagcaggtttgtctatgcatattcatcagtcaggactcctaaggagaccattctcccctcagtaggattccggctatgctaatggtaaagggatttcttaggccatttcctgggggagtttattctgtttctatagttgcagaaagggcagagccaacttcttgcagaggggggattccctaaagcaaagggtattgagggatgtgcatttttatttcccccttacccaggcccctgggtgctcaaattctacctggtgactccagtgtggcaaagtgaacagcttgaccagctgaatactgaacaaattctttgctttcctaatggtatgtttgacatcccaaaggagggaatggtcaaaacaactagatttttttggggttgggggtggggggaagtttaggtcaattgcatggtttaactgtaatttagactaccttttcttcttcacatgaatttggtaattgaaacatactgttctgttaaattcaagcacagatgtttgtttaatcacttacaggactatttccatatcatttcggttagagtttagtcatttgttgctcagctgtgttcagacctaaactttataaaaggcacgtgagtagagcctctcctagtgactaaggaacgtggaccttctctttccttttttttttaaattgaagtttttattgagataattgtaaattgacatgtagattcacttaagaaagagtacagagaggtcctatttacccctcaccccatttgccccaatggtaacatttttcttttcttttctttttgtttgtaagatagggtcttgctctgtcacccaggctggagtgcagtggcatgatcatagttcactacaacctcgacctccctggattaatcgatcctcccacctcagccccttgagtagccgggaccacaggtgcacaccaccacacctggctaatttttaaaaattattttttctagagttggagggtcttgctatgttgcccaggctggtctcgaactcttggactcaagcgatttgtctgcctcggccccccgaagtgttgagattacaggtgtgagctactgtgtccagctcatttttcaaagctatagtataatatcacaatcagtatcttgacattgatatactccactgatcttattcagatttccccagcttcacttgtattcatttgtatgtttgtgtgtgtgtatttagtctaacctacacatgtggtgcaatgtatacatttccaccacagtaaaggtataaaacagtcttatcaccacagggattcctcatgttgtccttttataaccacacctcgctcccttccaccaactcccccaaccctaccattcctaacccctggcaacaacgaatctgttttccatttctaaaattttgctatttcaaaatgttacataaatggagtcataaagtatgtaccttttggaatttgttttttccacttggtataagtccctgggcatttatccaggtggttgcgtatatcaactgttcattcatttttactactgagtagtagttcatgtatgtatcacaatttctttacatttgcctttggaaggacattggggctatttctagtttttagctattatgaataaagctgctgtgaacatgtatgtacaggtttttgtgtgagcatacattttcatttctctaggataagagcccaagagtgtaattgcgtgttatttgatacttacatgtttaattttataaaaagacaatcaaactatttttgagagcaaattaccattttagattcccaacaatatatgagtgatctagtttctttgcaccctggtccgcatttagtgttatcactatttttattttagctgtctgagaggtgtgtagtgatatctcatggtgggtttaattggcatttctctgatggttaattaattgaatatcttttcatgtgcttatttgtcatctgtatatccagctaagtgaaatgtctgtttatgtctttggctcatttctaattggattgttttttactaagatttatttatttatttatttggagacagagtctcactgtgttgcccaggctagagtacagtggcatgatcttggctcactgcaatctctgcctcccaggttcaagtgactctcgtgcctcagcctcccaagtagttgggattacaggcatgagccaccgtgcccagccttgttttttttactgttaacttttgagaattctttatgcattctgaatactagtcctttgagatgtggtttgcacatatttcctcccagtatgtggcttatcttttcatcctgttaacagtatcttttgtagagccaaagtgtctcattttgttaaggtctaatttatcggtttttttcttttatgagttgtgcttttggtgtcaagtctaaggactcactgcctagccctacatcatgaagattgtctcctgtgatggtttattttgagatggagttttactttgttgcccaggctggagtgcagtggcacaatctcggctcactgcagactcaacctcccaggttcaagcagtcctcctgcctcagccccccaatagctgggacaacaggtgtgcaccaccgtaccaggctcattttttttttttttttttttttgtagagacagggttttaccatgttgcccaggcttgtctcaaactcttgaactcaagagatgcacctgcctcagcctcccacagtgctaagattacaggtgtgagccactgtgcctggcctcctatgttgttgtttttttctaaaggatttatagttttacattttatatttaatgtgatctgccgggcatggtggctcatgcctataatcccagcactttgggaggctgaggtgggaggattgcttgaggccaggagttcaggaccagcctgggcaacataaggggactttgactctacaaaaataataatacaaaaaagcccggtgtggtggggtgcagctgtggtcccaactgcttgggaggctgaagtgggaggatggcttgagcctgagagatggaggctgcagtaagctgtggtcacactactgtactgtatcctgggggacagtgtttgaccctgtatcaaaaaaaaaaaaattctgtgatccattttaagttaatttttatttaaggtgtgagatttaggtcatgatgaacttttttgtcctatagatgcccagttgctcaagcaccatctgttgtaaaggatatccttccattgaattgcttttgaatcttttacaaaaccatttgagcatattcgtgtgggttgtcttttgagttgtctgttctgttccattggtcgctgtgtctatccgtctgccattgccacacagtttttattactgtatctgtatagtaaaccttaatatcaggttcagttcttcctcccactttatttttctttgtcaagattatttgtcttttttttgtttttcctaatatataaagaaaattactctttaggtcagttaataatcttattctgctaaaaaaattaaaagatagcttttagagactgcatgcgttagtttgtaatgctttctcctgaaagtaatggaatacctgactaatagaggcttaaagaagcagggatttatttttttcaccaagtaggaagcctggaggtgttaccagcggagggtgttcaggttcttggcatcgtgaacaaagaattggacaaaatgcacaaacaaagcaaggaaagaattaagcaacaaaagcagagatttattaaaaatgaaagtacactccacagtccgggagcgggcggagcataggggctcaagagcccctttacagaattttctggggtttaaataccttctagaggcttcccattggttacttgacgtagaccctatgtaaatgaagtagtggcccagcaatcagtttgactggttgcggaaagcaaccaatcagaggctgaagtgaagttacaaaggttacaccctatgcaagcatctgattggttgtggaaagcaaccaatcagaggctaaagtgaagttacatagttacactcctatgcaaactttctgcaatcaatcagagatactttttgctttctgcagccaatcagatactttcaattttccatctgccatgcagaaaaaggtgggggtcacggggagattgcaaagggagtagcctcccttgggtctttttgttacttaggtgtggaaagttgtggttttccttttgatttagttctaagaagtcagcgtaaattggccttaggttccctgcctccagaccctattctcttgcttcagaggtagatggctgctggcacatgtatagaggctcagcattgtctcagccagcatttctgcaatcttgcccattatcccaagatggctgctgcagctccagggatcatatatacatttcaaggcaagaagaggtgaatgaggggaacgtgacctgtatctgtcccttggctcaagagagcaaaaatccttcatagaattccaaaacagactcctaaaaagaggctgaggaaacaagtgcagtgtgtagctttttctggagtttttaaatggagacttgcaagggagaaggaatttgggaatggctgcacgaatcagctaccgtgagccagtggtttcaacttactttgggtaaaatctttagaattctgtttattgattggtgccttaagttgaattatttagagcaaaaatatcatagccttatgagaaagattctgcagatctccagatcttattgatttaaattttgtttttcactctactgatttaaatacattattaaatgtataaaatcaatcttattgttatattgagttgatggctaagaatcatgagcacaacactttttcaagttacttttagaaagagaggaaattagcttaaaaaatgtttgagattttctttgacgtgcctttttaatttgcacatttggggttagtttttgagtgatttagcttaattaataagtaatgatggctttcatgctcttatagtcttacattcttagatcccactatacctgaggcaattttgttattttctctgggaggttcacagtatctgctgaatgactttttcttctccatgaaagtacagcaaaaaagaaaagaataaatgaatttttaaaataaatattagacgagggaggaaaaaaccccacactattcacagaatagaagcaaattagtccagaacctgatcaggcagaaatatctaagaatgatagttttagataattctgtatcaaattttctattaacctaaaaaaatagaaaaataagttgtgttaatgtttattgaaatattaaatattaactatctctcttcaattcccaaatttccagtaactgctggtgactgtagagggatttctacagcactctcttttaatacttccccagcttttaagggattgagtctagatccaattatttggtctatttcctcccttccgggtcatggtggatgtttttgctattatatttgccaaaagcaaaagtaacaattcaatcctgatgacttaaacaaggagacatctattacttttctcaaaaagcacaaagaatatgaggcccattgcttaagggctcaggtgttgggtttgcattcctggattcaccacttatactagttgagtgaccttgggcaaattactaaaactctgtctctcagaatccccatctaggccagacacagtggctctgcctgtaatcctagcactttgggaggccgaggtgggcagatcgcttgagcccaggagtttgagaccagcctagtcaacatggtgaaaccccgtctctacaaaaaatacaaaaattagccaggtgtggtggcatgcgcctgtagtctcagctactcaggaggctgaggtgggaggatcgcttgagcccaggaggttgaggctgcagtgagccatgactgtgccactgcactccagcctgggctacagagtgaggccctgtctcaaaaaaaaaaaaaaaaaaaaaaaaaaaaatcagactccatgcataaaatagggatgatgatagaatatactcagagatttttctctctgaggattaagagcattaaaaaatttgcatatctcatttattaatgaggttaactatattttagtatgtttattggctatttccatttcctttttttgcaaagtgccttttcaaatccattgcccatttttctgttgggttttccttttcttagtgtacatatatatgagataaagagtggtctttccatatgtgtatacaatgtgtaatgagcaaatcaggcatatttatcacctcaaatatttatcatttctttgtgttgagaacattcaaaatcctctcttctagctttttgaaaatatataataaattatagttaaacatattcatcctacagtgctacagaacaccagaactcatttcatctatctactgtaattttttatctgttaaccaacctctccccacctcctctccttcccctttccagcctttaatactcccaatgattaagagaatttaatgtggccagacatggtggctcatgtctgtaatcccagcactttgggaggctgaggtgagcagatcacttgagcccaggagttcaagatcagtctgggcaacatggtgaaatctcgtctctacaaaaaatacagaaattagcagggtgtggtagtgtgtacctgtagtcccaagctactcaggaggctgaggtgggaggatagcttgagcccaggaagtcaaggccgcagtgagctgtgatcacgccactgcactccagcctgggtgacagagcaagaccctgtctcaaaaaaaaaaaaaagtttaatgcttctaaagtgcttagaacagtgctacaattgttagctattgtggcaatagaaatgacatttatattggcttatctagctcatggcttatctagtaagctgtcccattcttaccaggcacctcacactacctgcctttgtcttgtggttgtcaagcatctgggcttttgagtgtaggctagaaagaaacaagagactgctgtgctggagttctgaaatagaggttgcaaacagatcaacagctcctgatgtagatgactatagccagcttctcagtttggattaactttacggtttctgtagcggccttgataactaattgattaatcaacttatgcatgtgataaaattgcccttccaatttttagcaacgaggaaggggtgctgattgtagctttgaatttgatatgaagcagagtctggatttggctgccacctttccaacagtggtggaatgggaatcagggagttgagatgccaaggagcactgacctaggatctaggaatagttatgttcctaactttatcatttgctaagacatttgctaatttccttaaattgagactgagtaccaatacacagtcactatggcaaaggcaggttgccatgccatcttaagaggctataatggcaaatctcaagtttttgtaagtgtctgggggtgtgtgtgcatgggggcaaacattttaaataagtgccctatggactgttacatcatatcaaacaaattctcaatgcgttagtttctaaggtatagaattctgaattgaaatttcaagctaatactctaatagtgcaaaaatggagttttgcatgctatgtcaattagaataacaatagcaattggcatcactggacttaaaaaaaagtgtgtgtgttttgttgttttgagtttgaatgtgtgaattcacaactcacaagccaagagttttggagaggttttagtaatagttcctttcatgctaaaagcattgttttaaataattacgtgtggctgattttattttatttagcaagagaattggaaatgattaacaggtatctggataatactctttgggtggagaatttgctcataaatttagctgcaacttggttgaatgaactgcattctgactttgatatattttggtttcttctcaatttttatagcattgttggattttatgggccccacatgcttccacacaactctgttggccttggtggattttaatgtttaaaattaaaaggccccatcatatattcttagttattgttactattatagctggacaaagatatgctggtaagagtttgtagcaattgtgtgtgtgtgtgtatgcaggggttgggggaggtgggtttgcagtggttgctgcccctcaaagaagcaagcatgtagctatccaatgggttcttcttacccactgcccagatagagccgatttctcaaaacagaggaattgcaatagagtttcatacactcagagccagctaaatgggagaccagagttttattactcaaatcagtctccctgaaaattttgagacagaggtttttaaaagatagtttggcaggcaggggcctaaggaatggggaatgctgattggttggtttggggatgaaatcatagggaattgaagctgccctctttcactgagtcaattcctggatgggggccacagatcagatgagccagtttacctgtctgggtggtgccagctgatccatcagaatgcagggtctgaaaattatcttaggttttataatagtaatgttatctatgggagcaattggggaggttagaaatcttgtggtctcaggctgcgtgattcctaagccataatttccaatcttgtggctaatttattagttttacaaaggtgatctggtccccaagcaaggagcaggggtttgttttggggaggggctgttatcatctttgtttcaaatttaaactatcaactcctcccaaagttggtttggcctatgtccaggaatgaacaagagcagcctggaggttagaagcaggatggagtcaggtaggtcacatttcttttactgtcataatttttgcaaaggaagtttcaggcatacctcttttgaccttgttttttccagccccttctctttctcttgcagctgtggtagtgagtaggaaaggaaggttagccttgtggagggctcttgaatttcaatccacctcttcagcctcctttagaaatactagcagaaatgagcctcataccccgtaagatgttgtttaagtgtctgattttgctatttaaggctctctatggattgatttccacattaactcttcaaagttcatgtcccactactataggaaatgcccctgtatctagctgggtctagtcctggtccttcaacatgtttcagtgtcttttactctgcccaaattcagtgcatggttcaaggttcactttaagactcaaattctacatgattttttctctggcatcgactgctccatagtatactcctttgaattcctgtaaccctaatctatatacatagggttggctgtttgctacagtggattgcccaaaaaataaatcataaaaatagatggtatgtttaagttgaagaactattgactcatgcctatcaggccctgtgttaaatgttgaatgtttcttattcagcatttaacatgtggccctgcttccatggaactaagaggaacagtgttaaaagtgacatttaacccaggaatgaagatcacataatttatgtatgttcatggagcaaatattattatggctaagaatgtcataaaagtggagataaatctataaatctatttgtggaaaagaacatataagctcttgggttggttagtaagggagtcatacttggtcccttttttttttagacggagtcttgctctgtcacccaggctggagtgcagtggtgcgatctcggcttactgcaacctccacctcccaggttcaagtgatcctcctgcctcagcctcgtgagtagctgggattacaggtacgtgccaccacacctggctaatttttgtatttttagcagagacggggtttcaccatgttggccaggctggtcttgaactcctatacttggtccctttttattggagctctgactcagttctctctaaaagccaataccaagtccttcctcttgagaaaacaaaataataaatgctaacaggcaggcacaggcacagatattctctcacttagtcctaaccactgtctcgtgaagcaggtattattattctcactttagacatggcaagcctctggagaagtaaagtgactgctccagcatcacatgacccatagaggcaaagctggaaggtgaatgccaggcttctgatgccaggtctcctgtcctatcctttatgaccctattactccctggtgctgctctccattccaaatgtttgattattagatttaagggggtctaagccaggtaacatgaacagggaaagatcagctgacaatatctgattgtttgaaaataatccacagcttatgttctattcattcgatagatgctcattgaacacctactatgtgcaaggccctatagtccttactgtcagaaagtacaaagcctagtataagatgcaagtatataaacaggaaactatagtataatatggtgagtacagtgatggctgtacaggaattatgggtatagaatgaatgaatcaagaatgaaccttgtgagattgtttgtctgtaccactgctgccctttcaaggagcacgtgtattattttttagaaaacattttattctctgttctaggcacttggcctggccctggtgatacagctgggggtgggggaggggaaagggtaagttcctaaatagttaaagagagggtaaccttccagactttaatagaagatctatgcaggaacagaatgttctgcctctggcagtcagagaagactttaagagatgacatttagatgatcttttatttatttcttgcatttttctgagcttgggttattttaaggaaattataaatactagaaactcaagagttttgatttgcaataccttacctagagctgttcaaagagccatatggttcacaagctatttctgtccccatgattctgctgaaaccattctcgtcaaggtcaccagccacctccatgttgccaaatcagggggtcaagtctcaagcctcgtcttcatttgaattattagtagcatttaacacagttagtcacgtgttccttcaaatgctttctttaggtagtttccatgatactaaactctcctggtgttcttcccatcttaccagctgcccctttttagtcttgtttgctaattctaccccatctccctgatcacgtaacattgggatattttaaagctcagtcttggacttcttttctgcactatcatcattcattccagcactgtagccttaaataccatccatcaactgatgtatatcaaatttttatatccagcctcgacttcttgcttgaacttcagactcccatatccacctgctagtccacatttctacttgcttgtctgagtggtatcttgaatgtaacatgtccaaaatagaattctggactcctgtgcctgcctcctacctccagaattctcatttaagttctctcccaccattctacatcccagcacctaaaactccattcttctcgttgttcaggccaaaatacttggggttgttaataactcatctctttttccacaccctacatctaatctattggtaaatcctttttgttctaccttcaagatacatacagaacttgatcacttccactgtctctacttctattaacctggtctaggccactatcatttcttgcctggactattgcaatatccccagttctttgtattgtggccagagcgatcctttctatgccctgctcaaaacaaaatccagtgttccttaaacctctaaggcactggcccctgtttatactcttaacctcatgtctcaagttagaggactctagacctttcaaacaccagaataatgtggtgtcctgcaaggtaaggcctaacaggggaggttgtatgataatccagagtgcaggagtgaatggaggggagaagggactctcggtgactgcagactactgtttcgtgaaacatgaagatagaggatgggagggagtcaagatggtaacgaaagcaagactaagggcactgaaggaggcttttcttcctctaagagttgaaagacttgagtgtctttatgagttcattgaaaggaggccatggaagggagaggctaatgctgttgatcactgacttatcagggacacaagtaagccagtactgcaaggagagacagttaggacccacgtgaatatggaaatcataaattgactgcagtcacttttgtttgcttagttgcatggctttatcccaccacttcactctgtcttctggccagagccttctaattatcttcagtctactaccagcccttttgttatgcctgccagttaatcccagtgccttctcccttgttctgctccaggctcctgaacactgtggatgtgacacaggtcctgagggtcacattgcttcctggatcactattctttgtctcttaattcctgccctcctcccaggtgctttaaacttatctactccaagccagttgcagtggctcatgcccgtaatcacagcactttgggaggccagggtgggtggatcacctgaggctgggagttcaagaccagtctggccaacatggtgaaaccctgtctctactaaaaatacaaaaattagctggttgtggtggtatgcacctgtaatcccagctacttgggaggctgaggcaggagaattgcttgaacccaggaggcagaggttgcagtgagccgagattgcaccactgcactccagcctgggtgacagagtgagactccgtctcataaaaataaaaaaataaaaaaataaaaaaaataaataaaataaataaaaacttatctgctcctgtgacatttgtttgatagggtcagaggctgtgaaactttagaagcatacatgctgtctttggaatttaaaaaatgtatctacatgccaaccgatccattatttacttaatatctctctgtgaattgaatcacttttggaaaactaaaacatatttaaaagggaaactttatatccttaccataaatgaaaaccacatcatttgatctaagtggaaggtcatggtaagaaaaaaagaaatgaaaacaaaacagtgtttttagatttgatgcctacaaaaagttaggagcctgaggcctgctttcttttttataggcaagtatttgggaggtatagtcagtactaccaaattgagactcacccttgccttaatcgaaaggaagaggatagaggaagatgaacattcttgcgcgccctctgaaatcgtctccattaccaactagggtggcatccctggaaagagtgaggcccgggtgtttgtgtgcagagacagcgcaagggttggcatgctgtggcttgcttaatcagtttcagtttaagattggttgaagatcttcatgttaagatatggcagtggcctctttaaaagtcttttgtgcccggcgcagtggcttatacctataatcccagcactttgggaggctgaggcaggcggattacttgagcctgggagtttgagaccagcctggccaacgtggtgaaaccccgtttctactgaaaatacaaaaagagccaggtgtagtggtgggcacctgtaatcccagctacttgggaggctgaggcaggagaattgcttgaacctgggaggtggaggttgcagtgagctgggatcacgtcactgtactccggcctgggcgacaagagtgagactctgtctcaaaaaaaaaaaaaaaaaagtcttttgccttcagaccttcccccttccaacccaccctgcccactgttagtggatctgtcttcagacgtgctgcctcatattgtccctgtgtccctcgggaaactttaatggctccttgttgcctatttgatccagaccacaatgttcaatttggcaaccagtgaatctaccactcaagttttatgggcttcctgtatctgcagcaatatgttagatggtgaggggacatagaaaaaggcagaaatatacaccatggtcccagagtttaaaaaatgtgtcatctagttgagacaaatcaaacacgagtatgtgcacatattatggtgcatgtacacgacgaagggctggtggtcagagaaggcctcatgaatctgcccatccctgggcttggtcatcatatagctcatttgtggtgtgtgaatctcatgctggctggggttttcttttttattgtggtaaaatatacaaagtataaaagttaccattttaaccatttaaattatacaattcagtggcattttgtacattcacaacgctgtgcagctgtccccactgtttcaagaaaattttcatcacttcaaaggaaacctgtacccggtaagcagtcactccccattctttcttcctcccagtccctgccaaccattaatctgccttctgtctctatgaatttgcctattttgtatatttcatataaatggaatcatataatatgtggccctttgtatctggcttttttctcttagcataatgttttcaaggttcatccacatggtagcacgatatcagtgctttgttccctttggcggcagaataacattccattgtatggatataccacaactgtttaaccattcatcagctgatagacatttgggatgtttccaccttttggctattgtaaataatgctgctatgaacatttatgtgtaagtttctttctgtggatgtatgttttcaattctcctgagaatatactgagaagtgcaactgctggatcatatgatgattctatgtttaacttaatgagaaactgccaaactgttttccacagcagccatactagtgtacatccccaccagcaaggtgtgacagttccaatgtctccacatcctcaccaacatttatttttcattttaaaaaaattatagccaccctagtgaatgtgaagcgttatcacagtatatgtatgtatatatgtatttatttttgagacagggtctccgtcgcttaggctggagtgcagtggtgcgatcatagcttcatagctcactacagcctcagcctcgtgagcgcaagcgctcctttcacctcagcctcccgagtagctgggactatacgcatgcaccgccatgcctggctaatttttgtattttatgtagagacaaggtctcaccatgttgctcaggctggtctcaaactcctggactcaaatgatctgcctgcctaagcctcccaaagtattgagattacaggtgtgagccactgtgccaggcttcattgtacttttgatttacatttccctaatgactaatggcattggacatattttcatgtgcttgttggccatttgtatatcttctttggagaaatgagggtcgtggtcaactcagtataccactggaggctatatgagtaaacagcaaactttctcataaatgcagaatgttggcaaactgacaaactgcgtctgccacccagaaggaatgctgagggcagttatgccccaagtgcagtgtttattgtgattaggtacatcagaagcctgttagtaataatatgaacctgtgatcaattaaggagctgaccaatcattacctcctcctccctactcattctacccaataaatacgaagggctgtggaagctcaggggggctgcctttgctcactagaagcagggagctctcttcttccccggacccttcctttaaaacagtttcttttgtcttaagttttcatttctatgttcatcccccttcgttcagtctcgtaatgacggtctcaagtagtaacaatagtaactcttgtaatgacggtctcaagtactaacagtagtaactgttgtaatgacggtctcaagtactaacagtagtaactgttgtaatgacggtcttaagtagtaaaagtagtaactgtcgtggtgacagtctcaagtagtaactgtggcagtctaccacatcctttgcccatttttaaattcaattgtttgtgtttttgctgagttgtgagaatctttatatattctatataatagacccttatatgatttccaaatattttctgtcattctctgggtttctctgttttttagaaatgacatctcactctattgcccagggtggtcttgaactcctgggccccagtgattctcccagcttagcctcttaaagtgttgctgggatacaggcttgagccacctcacccaaacttcattctatggattttttcactctcttgatagtatcctttgacacacagttctaattttgatgaagcccaatttatttttccttttgttgcttgtgcttttggtgccacatgtatgaaacccattgccaaatccagagccatagtgactggcttctattctagggttgggagctgtggcttgcccaaggccatgtccccaaagtctctcacaacttagcacccaatggatgctcaccagatgtttgtagaagggatgactatgtagtgggatgtgagctgacccttggtggggagaggggtttgtgtagaagtatagcctgaccagggacatgactttgaatagacattaaggtaccttataagctgtaagatgtggtctgaccaaagaggagggtacacatgaacaaattgtggaattctgggggacaggtagctgagtgaggccttcaacggtggcaagggctttttccatgtgattatggaaacctagatccatggaggaaacttgtgagtagtggagaaagctcctcaggggaaggaaggctggctgtgacttcatctttataccatactctctagaatagggcctggccggtattaggctttagtaaatattccagtggcctgatgagggagacttttaagatatttacatgagaggcttttcatgatatagtcctccttatatattctactctagctcgccctccttccaaacttgaccttgactttctttttttaccagattcgcccctctcctaggtgctgtcagctcagctgcagtacatcactcctaaccctgcttggaacatccttgcctctcctctcctatctaattcatctcattcctccaggcccaagacagtatccagttatccacagaacctcaacactactactccagcacatcagtgtatggctctagtcagccatacacttagctatacacttaccagagcttagggtcacatgatcttaggttcagatgcaggctccactagttactgtgtaagcttgggtgggccagtctccctctctctgccttggtttcctcattggaaaaatggcagtaataacactgctaaaacagttctgtgacagtgaaatgagataataaatgagatataaaacccttagtaaagcatccagctcatagtaagcggtcaaaaatggtagctgtactgttttctagttgtttgctgtatttggctgttctcgtgttgctataaagaaatacgtgaggctgggtaatttattaaaaaaaaaaggcttaattggctcatggttctgcaggctgtacaagaagtgtggtgttggcatttgcttctgatgagggcctcagaaagcttccaatcatggtggaaggcaaagggagagccagtgtatcacatggtgagagtgggagaaagagagagaagggggaggtcccagactcttttaaacaagcagatctcatgtgaaataactgagcgacaactcatttatcactaaggggatggtgtgaaaccattcatgagagatctgcccccacgatccaatcacctcccaccaggcccccacctccaacactgagaatcacatttcaacatgagatttggagaggacaaacatccaaacggtatcattttatatatctaaatcttgcttcctccgcaagattgtgggtttttttcttcagggcaggggctgagtcttatgcttattttaactcgtatatttggcacaaagttaggactatagtaagtacttaagaaacatttgttggttcgaggtgactttgtgattactcggagttacttgctttaggagacagtatatcattattgaattctatattattctacgattcattttctgaaacccaacttttgctttgttttatggggatctgggactgacttgtggtaatctgattgtatgtgtgagcaagtgtgtgtgtgtgtatgtgtgagagagagagacagagagagagagtggagggaatggtggaggtagcgacaattgattccctaagggacagagccagctacagctcaccatcctaaccactgcatctagctttcctctcccagccctagagctgggctgttatctgcccagggcagctgttatggccctgactcccctggggagggctgctcaggccttcctcattcttccaggctgcctttaccacaaaaggaaatgaggtatttttgaccttatcagacttctctgccaaggcatcatgttttgcaagaggctattgccctggctatatacagtcctgggcagtgtgctaacattaaagaagcaaattcaggataatggttacctctggataagggaggcagggctatgagctctgagataaagcttcagttatctctgaggtatttattttttatgcagggctgtggggcatatgagtgttcatttattatcatgaacattgtataatcttgtatttgctgcttatcatttctatgcatgtattatccataaatattaccgtatttttcgagtattttccagctttacatatgtgtcgtgaaattttatgtgtacttcagctacctatattttttgcctggcagtttttgagatttgtctattttgtttgtttgtttttttgagatagagttttgctcttgttgcccaggctggagtgcagtggcatgatttcggctcactgcaacctccgcctcccaggttcaaacgattctcctgtttcagcctcccaagtagctgggattacaggtgcccaccaccatgcccggctaattttttatatttttagtagagatggggtttcaccatgttggccaggctggtctagaactcttgacctcaggtgatcctcccgcctcagcctcccaaagtgctgggattacaggtgtgagccactgtgcctggcctagatttgtctatattgatacgtgtaatattagactctgtattaatattccatgttataaagagatgtatcttttctgctattgggtagacatttcagtggtttcctatttttcacttttgcaaacaatgctataacaatagtctgatatgcagttccttgtgcctaagacaagatacttctgtaggagtggattggctaggccataggacatatatgcctctctctttgctcgtattgccacatcgctcctcagagtgattgtcctactttaccttcccaccagcagtgcacaaatgttgatgttggccatgtccttgccaacccttggtagttgtatctgtgctttctcctctctctccagatcaccagaaaaggtgggagttaaggtttttcaattaaaggagaatgtcagctctgaagaatttcctgttacatttactttaatgaggaaaagattttgttctctgttttggtgaaaataatgtttagacttctgtggaaaacagttacatacactttttattctgaagcagagcagttttttctttctttctttctttttttttttttttttgctgtttgcattcttggcaaacaagtaggaaagaccaattagcaagctaatgttctaaatatttacttgcagtaacagtcattttttaatgttttatatagcatggaacattaggtttatgtgtactgcttttcaatgttttgaattgattaaaatgaattaaatttaagaatgtgacacaactttatggataaagattgatcataattatttgccactttatttgcattttgtgagggaaaaatacatggtaagaaaatgtgttgacattttacaaacaggttagaaaagtcataaagagtaactttggctattttatgttgtctcttatgttcacaggtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtaagtcacatgacactgggaggaatgcagtcttagcattttacagatgctaaataatttagttttgagaaagtaggagtcttcagtgtaaatgttaaggctagttctttttctttttgccttttctacttattattgcctttatttttagtgttttatttttagtgtttctccctttgtctttatttgtttaaattgacaaacataattgtatatatttatggtgtacaacatgatgttttgaaatatgtatacactatggaatggctaaattgagctaattaacatatgcgttacctcatgtgcttctctttttttgtgatgaaaacactattgtcttacaattttcaaatatacaatacattgttattagctatagtcattgtgttatacaatagatctcttaaacgtattcctcctaagtgaaattttgcttcttttgactaaggttagttcttctgaaaagataaattcaagaacaaaagtatcctaaacaaagaaaaatcattcttgctctgctcttttttatcaggcacattggttgcagaatgccaaatgtttatctttcttggctaatgcttattaacctttctctcatctccttcactggacaggataatctgtcctatagaaactaagagtctcgtcagattgtcacttttgcttttgagttgccattgactaaataattgtgtttgagtctgaatgtggctttaaataggaatagaaaaatgccttctcttcttttctccatactaattagtaataaaccgtagtaatgattccccatccctaagggctaaaatgtgatgtggcaagaagaatagtgaaaggaagtgatgccattattagacaagagttggaattttttaatgtatatgtctatacacatacacacacatatacatatggacatattggcagttagaaaaaggaatgtatttgaatattttttaaaaaggctaagatcagaggaaagaaaaggcgaccagctatatggatatgctgtgtttatcagatagccctgtatcacagcccaatgttctgttctccagaaagaactagttattagattattttagatcctgtaattgaaagatagttcaggactagataaagaattgaaaccatagcatgctaagtttaccaggtggtttttagcagcttttaacatggattggttggcagtactttgattctaattaaaatgtcctcaaattgacacatccccatgtcatctgtgatagggtagatcaattagagtgcacatttttttttgaagcctagttctgacacttatagtgatctaacagaccacagggaggcttccttcctgggaaaccatttctcctttcaacatgggccaatattcttttcttggattattttcagtacctggctcagtgctggacccaaagctcaaaaacaattctgggctgactgacttgggtggattatgcatagttttctgttactctcaatcttataggatgtttactttgcatgggccaaagaaaagattctatttttacctcatgtaaaatagagggtatcgacaatattttaaactaatccactactgaataagtatcgtaggccacaatgtattaatattaaactattctcttgcatttcaagtcgaaaagtcatttcatgtttttctcaatatttaatatgtgcctttcaagcctattttgcaggcctttaattacttatgtagaatatttcatgaatctggaataattttagcttcagactacttgagtaaacgaagagcttgctcatttcagggctaactaaatgcaacataattctttcagttattttgttggtcaacttctattaaatattcattgagctttaaatgagacactaagactgaaatatttacgtgctctgatgagactgtgaactacagactagatcctggttaataccccaagcaaattataaagcgctttctacattagcggttcaacaaaaacaagtcaacacttgttaatcatttgtcttaaaaatgagacattttcagtgcaccccatcccagccgcccggtcccggcccctcactctcctttgccgcgctaccaccatgctctccgtccgcgtcccgctgctgcacattacggacccgcagcagctgcagctctcgccgctgaaggggctcagcctggtcgacaaggtgaacaggccgccggccctgagcgggacccgggttctggccagcaagactgcatggaggatcttccaggagcccgcgagccgaaaactaaagcagctgcccccggcgtggaggatgagccgctgctgagaggaaacccttgccgctttgtcatcttccccatcgagtaccatgatatctggcagatgtatgagaaggcggaggcttccttctggaccaccgaggaggtggacctgtccaaggacattcggcactgggaatccctgaagcccgaggagagatattttatatcccatgttctggttttctttgcagcaagtgatggcataataaatgaaaatttggtggagcgatttagccaaatagttcagattacagaagcccgctgtttctatggcttccaaattgccatggaaaacatacattctgaaatgtatagtctccttattgacacttacatcaaagatcccaaagaaagggaatttctcttcaatgccattgaacgatgccttgtgtcaagaagaaggcagattgggccttgcgctggattggggacaaagaggctacctatggtgaacgtgttgtagcctttgctgcagtagaaggcatcttcttttctggttcttttgcatcgatattctggctcaagaaacgaggaccgatgcctggcctcacgttttccaatgaacttattagcagagaagagggtttacactgtgattttgcttgcttgatgttcaaacacctggtacacaaaccatcggaggagaaagtgagagaaataattatcaatgctgttcagatagaacaagaattcctcaccgaggccttgcctgtgaagctcattgggatgaattgcactctaatgaagcaatacattgagtttgtggcagacagacttatgctggaactgggttttagcaaggttttcggagtagagagcccatttgactttacggagaatatttcactgaaagactaacttctttgagaggagagtaggcgagtatcagaggatgggagtggtgtcaagtccaaaagagaattcttttaccttaaatgctgacttctaaatgaactgaagatgtgcccttattttgctgatttttttccatctcataaaaaaaatcagctgaagtattatcaactagccacaccatgaattgtccataatgttcattaacagcatctttaaaactgtgtagctacctcacaaccagtcctgtttatttataatgctggtagtatcaccttttgccagcaggcctggctggctgtgacttactatagcagtgacaatggcagtcttggctttaaagtgagggttgaccctctagtgagcttggcacagcaggattaaacagtcatttaaccagcacagggagttgaaagttgaaagatgcagcctcactgcttcagcgcagatttcaatgtttacttaaatataaaactggcactttacaaacaaataaacattgtttgtactcacaaggcgataatagcttgatttatttggtttctacaccaaatacaaagcattctcctgaccactaatgggagccaattcacaattcactaagtgactaaagtaagttaaacttgtgtagactaagcatgtaatttctaagttttattttagtgaattaaaatactcgttaaccaactttaaagtcagtcctgtgtttagatagatactagtctgttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttttttttcttttttttttcttttaatacaagaatatgtctctttttattgaggtcttttttatgtgctatgattaaattaaatgagataatgctttaaaagcacttatatgtgggagctaaggtagtattgtaaaacttcaagtcatccttaaacaaaatgaccaacctaagatcttgctcctgttaagtggtgaaatcaactagaggtggttcctacaagttgttgtttattctagttttgtttgtgtgtaagtacgttgtgtgagttaattcatttatatttactatgtcttttaaatcagaaattttttattatgtatgtccttttagattttacctgtagttcatactttaaaataatcacccagtgtcttattctagcattgtctaaatctgagtattatctaggggaatcttaaacttcagtaggaaaccatgagttattcatacagtttccattcaaatattaatttcagaacgaaacaaaatttttttttttttttgagacaaagtctcgctctgtagcccagtctggagtgcagtggtgcgattttggctcactgcaacctctgcctcttgggttcaagcaattctcctgtctcagcctcccgagtagctgggactgcaggtatgtgccaccacacctggctaatttttttatttttagtggagatggagtttcaccatgttggtcaggctggtctcgaactcctgacctcaggtgatccacccacctcagcctcctaaagtgctgggattacaggcatgataaacaaatattcttaatacggctactttgaattaatctgcctttatgtttgggagaagaaagctgagacattgcatgaaagatgatgagagataaatgttgatcttttggccccatttgttaattgtattcgctatttgaacattgtcctgttctattgttagtttccttcatcatttatggtatagtcaatttttaaatctctgtaatataatacattttcctatcttttaagttattgttacctaaagttaatccagattatatggtccttatacttgtacaacattaaaatgaagaaagccaaaaaaaataaaagacgttttcaacttgttgccagtttttccagtagcttttaatcctagcaatatatctagcattacactctcaaataatacaaagtaaaaataaagacagttctttggaaagtgtattaaaattaatatttgtagtagatgctctttgtgcccacccagatccatgctggggtggtgatcccccacccccagctgtgacaaatggtttgacaaacagctcacacctgtaaccctctctggagacttgctcttggctgatgggagttgcatctctcagagacacctgagaggttacactggcccctttcccctaagagggggcagctaataactgatttatcaagggtaaaaaaaggtcagcttccttgcctgaaggggggataattctttgctatgattcaggctccatagcccctcgtgcatcagaccaaggctacacttgacctgagaatgcatccttgcttgcgcggttcatttccctttcctttgctgcttccctcactcccttacaggtttctcccaagagtctgcccttaataaatcacatgcactaaaatccctgtttcaggctctgcctctatggaaccccaacctaagacaacattccaggttttaatccataattctgaaagcaaccaccaaaatgccttgctcaagtagactatcacattacaagcagagaaaatgccttttgcaatcatgaaaaggagccagtatttgttatcccgcatggcccctgcggcagacacttctagctgtttatcctttatgcattctacccttccttcttataggcagaacggttttatgcaggctggaattgtgcccacttaaatgtgttacctccccaggctccttgcagctagggctggccgcatgactcacttttggccaatgatatatgcattaagatttattgggtggggctcgtgggagagttactatttttctaatgaaaacaggctcagcaggtatgattttcctaccctttgccctccttttgtttttcctgtctggaactagtgttaccgaaccaaactgggtccatttacctgcatgcaagggaaagccaaacgccaaagcaccaggtttttgcagcaagaaaggtttattgagttgattggcaaggagacaggaggaaacactcaaatctgtctcctggagctgggggctgggtcgggttttataagcatagtgtaatgaggtgtgatctgattgcatcttgcaatgaggtgatgctgggaggcataatctgattggatcctgctatggggtgacaccagagcacgatctctttggttcctggatcctgccatatggggtccacttcttaattcagtccctgttccttggtccaagcacttaggtttcacctgtgcacacttggttcaactgggcatgctcgggttgtatgaccttcaaccctggggtccacggcaactgaaaaacaactcacgattttgttttataaaagttgaactagattagtctggtgcggttacactaggacataattcctagggcacagcagctatcttgtgagcatgacagagataaaggaaacctaggtccttgttggcatcatggagccactgtttaaggcccaggctgcctctctttggacttgtagttatgtgagaaaaatcaggctatatttcagagattctcaacctagcaaggtatttggaaatatgtggaggtgttttgagttgtcacaatgatcaggagcagggccagactagggtaaggcaaatgaggcacttgccttcggtgcaacatttggggtgccccaaaactcagcaattaagctagataatattttattatctaattattattattatctgttattaagctagtataatattttaaaaaatcaaattaatgccagaaattcatgatgaacaaaatgccaacattttaaataaagacaagatcagcaactgtgccatggaagttatattggagcctgaggcaaaaggaaaaatcagtaatactgatccaatcttcattaaaaatttggcattttgatattttgtttctcctggatattttgcattaattttgttttattttattatttttttttgaggcggaatctcgctctgttgcccaggctggagtgcagtggcacgatcttggctcactgcaacctccgcctcccaagttcaagcgattctcctgtctcagcctcccgagtagctgggactacaggcacccaccaccacacccggctaatttttgtatttttagtagagacgggatttcgccatgttgaccaggctggtctcgaactcctgacctcaggtaatccacccccctcagcctcccaaagtgctgggattacaggcatgagccaccacgcctggcttgcattaattttgatgttttaaatcgcctcaccctagggccagccctgaccaggaggtgctgctaccattgagtatccaggggccaagtgtatattttatatcctgcagtgtggggaaggcaaccctacattggggaaaaattgttctacctcaaatgccaatactgtttccaccgagaaacacagtgtgtgtactacttgcttaaaacccgtagcattgggagaatttctaaaaacaggcaaaagaattttgcttaatactgcacccacccttcaaagacttcgttatttcattgaattcatttaaataaaagcagactatgatggggccaagacaaaaacaagactattccataatcataactgtctgaacacagaacacgaacactgtccaagtcacaaaatgcatcactcacgccagttatttccagtcatcatcccagtacctccatgagtaggaagcaaatatagacggttgtcctcatcatataaatgaagaatcattctcaaggagaaatggagcaggaaccagagtctgagactgggtgttggaggcactgattctggttctggtcccgccattaactatatgtgtgattgtggcttagtcactttacctctctgagcctcagtttccttaactataatgcaggacttggctagctgatctgtaaggcccttttacctctggcaatttacgtctaaaacttgactaaagtcaaattcagcttgtttatcctagaactgagcccagaccctggatctaatggcctaggactctctaattacatcaggcacccactacttcattattaattgaaatttggcatttagcagtttatgctacgctatggtggctgtataagatctatagttagctgcttttataaaacgttggaatatttagaaatatacaaatgactgaatgtttttatatgactttcgtctggaagttaagccccatttacatagactctacaattttgctctcatttttcatttgtcaacagctcctagttagcctaatttgtttgctatttcacaaatgactcagttatagtaagtggcaagataaaagttgatcttatgggatatgcatacatttgaaaatattatttctttttttttccatctattgtaaacataatggttataatcaaaactactgaccgcacaattgaattttaatcacttacattaattgacatcgagcttgtaatgagctgattatttatgtagctgattatttatgtagctgtgtgactctatgatttgaacaatataaaaataaatttttaaaatataatttggtcccctgggtcatcttgatttttttttttttttttagattaaacaagttagtttattattcatttgcagcaagggaaaaaacataccctaagcaactgtgggatgtctaatgaagcaggtgttagaaaaggcttattataggatttgggcttgtgttaagtaattgtggggagtgattaaggaagcagggctttgctctggattgggtgctatcaggaagtaggggtacatctacaactgggtatcttaataaatctcagagggagagaacagactagagtgagtctatacctataattgggagagaagcagctgtcacttctgtgagccaggagagggggatgtttgacatttcatggctggacaaggttcattttctgtgtttagatgtgactgtggagtggtcttggttttgtcttgatccgtcacggtcacagagtggccttgtctgatgttggtggtctctgaaattattcttgtttagcaggagaacaccaaggcctagctgtggatgccaggccagcttgtaacagcaccaagaccagctgatagtataggccggctcctggatgtcaggggctacttttctctttcttacccagtactagctagaatttttaattttcctgcggtaggattaacgaatgatcaggtacattataatttcacttgcttaacaaagaacaatacgtaaatacagattcttgaagttttgcctaaagccagttaggaatgttataaaatataatcagaatatataaaaataaaatacaattaagcttttaaaaaaactggaaaatacattagatataccattaaaccatacccgaaatttcaaatggaaatctttctataggtttatataattctcagattatctgactcttgctattaccatgtcataaaagacaccaacatgtataattataagacaacgtaattgcaatacatttgccgttttaatcccatgttttacatcacaagtacacagatcttcagctatttagttttagagaagaaataaaaaatcttgcctgaaatcaaccatgtcataccccaaattctcaactatgcattctgcatttgtcactaagaataaaacacttagtctttaaatttatattaaagtgataaagcttccaatttcattgtattatgtaggtttctttaatcttcttttgaaattcaaaaggcacttaataaaaataatccccaagtctggaataaatgtttttggaataaaaagaatgagaatcataaatgagccttttactaaagaagagagttcttccttccctcttttctaaaacctagaatttagctatttgacaacattttaaggcccttccctcaggccaaaactttttatcagtaactaggcctgtggcttattctgattagtccaaagttaaaattgtctttttgaactttaacttttgtaggtaccactacatccccattagaatggctataattttaagactcttaccactaagtgtcggtgatcatgtagagaaactagaaccttcatacattcctggtaggaatgtaaaatggtgctgccattttgaaagacagtttgacagtttcttagttaaacatatacttgctgcatgacccagtaattccacttctatgtatccatctaaaagaaattaaaacatgttcacacaaaaacttctgtgtgaaatgtttatagcatcattattcgtagtagccaaaaaacagggaacaacccaaatgtcccttaagtaataatggataaacaaaatatggtatatctacataatgaaaactatacaacaataaagaaacctaatgatatatatgttacaacatgggtgaacctcaaaaacattacactaagtaaaagaagccagacacagaagacttcctattatatgattccatatatatgaaatcctagaaaaggcaaatacataggaaaaagcagatcagcagttgactggggctgatggtgggagaggggacttttgtgggggaagtgatagaaatgttttaaactggattgtggtgatgattacacagctctgtaaatttacaaaaagccattgaactgtatgcttaaaagtagtaaattttatggtatataaattacagcttaaaatattagtttgtttgggttgccattgtaactgcccaactggttcaccatgcctgctgcctagacagagcccatttatcaagataggggaattgtaatagagaaagagttattcacacaaagctggctgttcaggagaccagagttttaatattactcaaatcagtctcccacaaaactcaggaattgggttttttaagtataatttggtcggggggggagtgggttggaaagtggggagtgctgattggtcaggttggaaatcatagggagttgaagctgtcctcttgcactgaattgttcctgggtgggggccacaaggccagatgagccagtttgtcaatctgggtggtgccagctgatccattgagtacagggtctgcaaaatatctcaagcactgatgttaggttttcctttttttttttttttttttgagatagagtctcactctatcacccatgctggagtgcagtggcgtgatcttggctcactgcaacctccatctcctgggttcaagcgattctcctgcctcagcctcccaagtagctgggactacaggcgtgtgccaccacgcccggctaattttgtgtatttttagtgtagatggggtttcactgtgctggccaggatggtctcgatctcctgacctcatgatctgcccgccttgacctcccaaagtgctggtgttacaggtgtgagccactgtacctggtgatgttaggttttataatagtgatcttattcatccccaggagcaatttggggaggtttagaatcttgcagcctccagctatatgactcctaaaccataatcactaatcttgtggctaattcgttacttctgcaaaggcagtctagtccctaggcaggaaggggttgttttgggaaagggctagtatgtttttgtttcaaagtttaactatacactaagttcctcctgaagttagtttgacctatgcctcagaatgaacaaggacagcttggaggttagaagcaagatggagttggttaggtcagatctctttcactgtaataattttctcaattatgatttttgtaaagacgatttcaccataacaaaatactacagactgggtggcttaaacagaaattttttttctcacagttctggaggctggaagtccaaggtcaaggtgctggcagggttggtttctcctgaggcctctcttcttgtcttacagatgactaccctcttgctgcctcatcctctgtgcacactaattatagttattttgaacataaaatccttgtcatttataagattttagttcacaaattaggaagaaactgatagtcactatttgacttgttgacttaaattttaggctgatttatattttgttctgaacttttaatctataaaagtcatggttatttatgtattcttcccccccgagttcaaaccagctgcaagtttatttgaaatattaaaaaaaaaattatttaccttcctttattttgtatttgcaggactctgccctatggtaaactcactttttgtaacgctgatggtgggtgatagcacaaatgccatagaccatataatctagctgtattcttaaaaaaattttttttaaagtaattttggactcacaaaaagtcacaaaaatagtacagagagttcctgaatacccttttcacagctttccccgatgataacatcttatataacagtttgatataccttatcaaaaccaggattttaccttctgcaacatggtaaaacaagaacaaaaatgcaggaaatcagcattggcattgtgaaccccaaagtatctgagacaggtctcaatcaatttagaaagtttattttgccaaggttaaggatgtgcctgtgacagcctgaggaggtcctgacgacatgtgcccaaggtggtcggggtacagcttgctttcatacatttttagtgagacataatacatcaatcaatatatgtaagatgtacattggtttgatctggaaaggcgggccaacacaaagccggggagaggcttccaagtcacaggcagattcaaagattttctgattggcaattggttgaaggagttattatcaatataaaggaatgtctgggttatgataagggcttgtggagaccaacgttttatcatgcagatgcagcctccaggaagcaggcttcagacagaatagattgtaaatgtttcttatcagacttaaggtctgtgttgacgataatgctggtcaacttttcctgaattccaaaagggaggagggtataataaggaatgtctggttcccccttcccatcatggcctgaaactagtttttcaggctaacttgggaatgtccttggcctagaggagggatctgttcagatggctggggggcttagaattttatttttggtttacagtataatactattaactaaaccgcaaactttatttggatttcaccagtttttacatgcactcactttttcccccttagtttaacagtcctgtggaatcttatcccatatatagattcatgtaaccaccaccatgttcaggatacagaataactgtgttctttaggattttgctgtttgagtcctcatttattgaggtaaacttcattttaattcttaaaatcaactttattgaggtataatttatatgtaataaaatgagcctttttttttttttttttttttttttgagacagagtctcactctgttgcccaggctggagtgcaatggcgcggtctctgctcactgcaacctctacctcctgggttcatgcaattctcctgcctcagcctcccaagtagctgggattacaaacgcccgccagcacgcctggctaatttttgtatttttagtagagacggggtttcaccatgttggccaggctggtctcgagctgctgacctcgtgatctgcctgcctcagcctcccaaagcgctggcattacaggcatgagccaccacacctggccaaaatgagcctattttaagtatacaattccattagttgtgacaaatgtatgcatctgtgtaaccaccaccccagacaccgtctagacgtctctgttgcctcaggaggttcccttattcccccaattcgtttagccctttcccattgttctgacttctatcaccatagcttagtctttcatttttttctcagatttcagataaacggaatcttatggtgcatctgccctggaatctagcttactgtttgagatttaagatttgaggcgcagctttgacaatgtgtatataaacaaagtgtagcaaattcatgtaataatatactataacagatttctgggcattttacagtcctttttagtcctctggtttgatatccctttactttaaaacattctgcttcagttttttcaaattactcttctaacctccttcagaggttttaaaatactttaagatgttaataacaccacattattcaaagatatgaagaaatgcttatctccattcttttttcaatgttgtcccatttccttttcttttattccatctctctcaaccttcttgtcccttcccttctggtgttttttttttttaattttatttttatttttatttttttaccttttttctgttttcttttctcttttattggacttctgtctcttcatcctcattctctttactttcatccatttttattcatcttctattgtgagtgccctatttaactttcttcctttccttactttgtcttcgcctgtttctggccttgcagttgctgacttctcttcttaggagagtatcatcattgttgtcatcatcatcatcatcggttttttttttttttttttgagatggagtctcgctctgtcgcccaggctggagtgcagtggtgcaatctcagctcactgcaacctccacctctcggtttcaaatgattcttctgccttagcctcctgggtagctgggattacaggtgcacgccaccacacccagctaatttttatatattttttttagtatagatggggtttcaccatgttggtcaggctggtctggaactcctgacttcgtgatctgcctgcctcagcctcccaaagtgctaggattacaggtgtgagccactgtgcccagcccatcattgatattattattactagggcctttccccttcccctttcccctagggctggacccagggtatatatgtctctccaaatggagtgttgtctgaaattaactctgtgtgcagtgtctagggtgttctttggaaacatggcctgcctgcaatacctccttaatgagaggctctttggtatagtagaaagaacaaggcttttcagttagactgaggtttagaacctggatttaccatctattacctatttcatcctggccatgtttttaacctctcttagcctgaattccctcatctgtcaagtgggaataacaaaacccaccttagagttgccgtgagtatcaaatgggtaatgcatgtcaaatgcccaggtcatagtagtcacgaagaattatttccttacatggggtggggagagcagttttcctaggggaagtgaagcataagctgggactatcccaatgctcatttgtgctacaggattcttgcatttttctttgggaaaaattctgggattttccagaagaataaatttggagatgctaccactgagcccagtgagttctaaaaagcagctattaagctatcattgtattgctctttccaattgttctgggcaccatttatgttgaaattagggtagttcataaaatcatatattgtttaaacaaaagattttgtcatgtctcttctattttagcaaatttacttaatggtcttttaggaggaaaggtgataaataactaccttttaaattattttattttttcattattctgaactaatagcagtcagtaataggctgctacaactgtatttacatgcctattattcataactgtactcatagattttataccatgatcctctaggttctagaaatttcatgcaggtccttttatgtttagttgaaattgtacttcctttgcagtctaccatgttcccccctttttttggcttaaaatatgaaatatgttttgcatgcattttattatttctctttgattctacttgttgatatttttcattcagaatttcaaagcatttatttttgcatttatatttacatatcaaaaatatcatattttaatagttttacatattaaaactattttcagttctggtctacttggcttttacagtcagctttatgaattgaagctttggttcttatgggtaggtaatggagataatattattgtgtgttcccagctttctccttttccacataccctgcctgctaaacaaaaatttgtctttgctcactccacttttctccacctccatcctctaaggattcttctgactttttcagttgttcttatgctttgtgggatataggaaaggaagaagtggataggagggagagagagtatgagtgggagagcactgatggtgatgaaatgtgaaactcgtgagaatcgaaaaagagagaaaaggcttttttgggggagaagtgtggatgtgcagcataaattggatcacctttagattttccttggaggtctaagtgaagatgaaacaggattttcaattgctattagttgctgggccttttctttgaatatactaccatgctgagactaagccacactggcttattatttgagttacttctaaatgttaacttactaaatgatatatttttgtgtatgcttacacaaataagagaactgccattacccacccctctcccaacactgatcagttgacctaagtcctctcgtctccctctgaaatctccctttcatcagtctgcttctttccatggccactgctgccatcctagttcatctttcacctggagagtagcctccgttgaaggcatccctgccttcaatataattccctttctcaactgcccactctgctacagagttaactttctaaaatgtttagactcctttgacctcctttgcatggcttagggaccacctatattttggctcttgtacctttgtagtctcatctcctttgctcccccatcaccactcaacccttagccacacaaaatgacttgcagtaccccacataccgaacactcctatgctcccataactttgcacatgctgttcccctttgcagagaatgcccttcccttcttgtccacttactccgtctttcagcccattgaagacccatttcagatgttacctccaccatgatgccttctgcttaatactttcaggtgactggcaattccctctccttttggagcattttcataaacccttattactcttctctgtgtcctccactgagcaggagtgagtggagattttgtggcagttcagggcatagtggttaagcttgtggcctctgaggctaggcatcttgtgttcccagctgtctcattctcttactttgagactgtgtgtagattacttaacctcccaaatcttgaattctataaaatgagaatcacagtattacctactttattggtgttttgtgaggagtaaatgagataagagtataaaagtacttaatacaatgcctgacccattataagtacttaatcagtgttggctattttatttagctttgaattctcagagcttagcacaacgcctgacacatggaagacaacttggcaatatatacggagctacaatattattaagtctttcctaatggcttttagcttttatctccaatgcattatcattatttggaggtaccatactctgttttgcagttatttgcatatagtcttattccccttacttgactgtgtactctttgtagctggagagattgtcttattgagtgttgtatccacagcacagagctttgaacttagcaggtattctgtggctggtttggtttgtattattttccattagtaatggaagtacccattttgtgaccttggttggtgatgcacttgtgggaaataaataacatactttgggatcattaaaatcccattaaaatcatccaatgtactgggaggtccaatttattgggtaattactagaattatagaacaaattctttggactggaggagaacataaagggcatcatatccaagcatctttcttctgactcttttgcatggaatccagcttttaaaaaatattgcaaaatgatggcatgaaggagtgtttttgccttggttctcatattattcctgctaattttacacacacacacacacacacacacacacacacacacacacacacacgttgagtataccaaatctgaaaactttttgagtgctgacatgatgccacaagtggaaaattccacacctgccctcatgtgatgggtcacagtcaaaacacaagtgcacaacacagtttattcagcatcccaagggaagaaaaagcccttccaacccccttcacctacagtatagattctttgcacatgtccagattcccccaaacaagcatgcctacaaagtgtaataaaatggcacatgtgcaggctggatatgccaacggcacgttccccacaattccccgtgtaggaccaagaccttcgtgcattactcattgtgtatttttgcttattctctgctctgtggtgtaaagatattgttgaaaatgtcaaataggtctgaagatagccctatgggtaagaggaaggatttatgtgtatccatagcatagaaagtcaagctgtgggagaaactggacagcagtgtaactgtgaagcatcttacaggagagtatggtgttggagtgaccactatatatgacctgaagaaacagaatgataaacagttgaagttctatacaaaagtgatgtatagaggttattaatgaaaaatagaaaaacagtgcataaagctaaaaatgaaggtctcaaacatgtattgaaagagtgagtccatcagtatcacagtgaacacgtgccatttaatggtatgctgattatgaaacaagcaaagaaatggcaaaaattttgccattgctttcaatggcaaaaactgtaattatttttgcaccaacctataatagctgaaatggttctaaatcaaggtgatgatgaagatgacattgctaactgtaaaaaaaagtgcctatagatgatgtggtgaaattgtgatgggattattggatgactagagccatatgcatccataacagaacaagaaatcatgtcagttgataaaatcaggggcacttataagacaaaaacctctattaatgaggctgataactctggaggaaacatttaagaaagccatccagcagaatgcctcctcatctctagaggacctacttcctggtccctcaacttcttctgatgtttcttctcacctaaaaaaatagagtgtataaattagctgggcatggtggcacgtacctgtaatcccagctactcaggagactgaggcaggggaattgcttgaacctggaggtggaggttgcagtgagccgagatcgcaccactgctgcactccagcctgggcgacagagcgacactctgtctcaaaaaaaaaaaaaaaaagaaagaaaggaaaagaaatacctgagactaggtaatttataaagaggtttagttggttcatggttctgcaggctgtacaggaagcatggcacatctgcttctaaggaggcctcaggaagcttccaatcatggtagaaggcaaagggggagtgaggcacttcacatggctggagcaggaagaaaaggagtggggaggtgccacacacctttaaacaaccagatctcatgagaactcactatagtgaggacagtaccgagggggaaatccacccccttgatccaatcacctcccatcaggacccacctccaacattgggaattacaatttgacatgaaatttgggtgggtacacagatccaaaccatatcacatgtgaataagtgtaagaaaattattgcttatccaaagcatataaattcagtcaggaatgatgattatgccaaataaccacagattgtccatatgagtggctgagatagtgacacctttgctttctgatggttcaatgtacacaactttgtttcatgtgcaaaatcattaaaaatagtacataaaattatctttaggctatgtgtataaggtgtgtatgaaacataaatgaatttcttatttagacttgtgtcccatccccaggatatctcattatgtatatgcaaatatcccaaaatctgaaaaacatctgaaacactctgttctcaagaatttcggatatggggtaccgaacctacatatgtacatacatatgtgtttctgtgtgtgtgtgtgtatgtgataaatgaaaaatattataaaagataaaggaacaatcatatatgtatatatatacacacaaaaaaacacacatatatataattttttatatggtaggtgtttttcttttgtatttttcatattgaatgtcagttttcttgattcagtttataaaactccatgattagcaatgtgatttctgcaggatagggtgaccccctttcttctagtcctagtatcatttttccaggaagtctgattttaaacagtggtttggaatctcttctcttagtaatatcaagtgttttttaattgcttgcgcaatagactccataaggatgtgaagactattttagatatggttttgacagtattttcaagcttccagctttgcatcctacactgatttatatattattcagtatttttatacattcattttctctccaaagctgttatatatacataattttcttaattctttaaatagtgctgtggttatcactgtggttagcaagtgttgattttctaatttttgctgaaaggttaatcagtgaacaaagagcttaagtggtttgtaccagtgatgtagttaattagtgataaagctacgtgaacattctagcattctagccacttccctttccattttcatgcatcataaaatcatgtcttatgcagacaagtaaaactaaattttatgaatgcttatattgcccatacaggtgcattttatcttaaaccatagatttagtcatgaaaacttgagtatcgattataaataggtttatgatatttttgtaatacaaaaaaattctttggaagtcatccctctgtaatttatcttttttgttattcatttatgcaacttacctttattgaccatctcttatgttcaacatgctaaatgagattcaggtttgtataacttgagttttcttaaaataagatacgcctatataaacacagtatccataggaacataaatttatcaaaaaatgaagtgagaggaaaaaaataagaatttggagtgagattataacttgagcattggtatttagatgtacccccacctccacaatcccaattgaaatcactgcaaaattttaaaatgtggagaaactaaattcatgctggaggccagggaggtgttccaccttcatgttgcaaactttgaagagtttccacctgatatagtgcagatgggatgatactgaaagaatatacccaaacgaacttgcaatttcacttcccgagaaagtgacaagaatcgagttgggggttaggacaacctgtaggggtttccacatggtttactttcacaactattgatggcttaagagtgtcactaggagacccagaaatatagtcacactgaagtcaaagcaggccctgcattcgggcttttctctgatggaacaggcaacggcatacaaaggactggccactcttcctggagtggaggttgggtcaactcataaaatgtttatatggaaaattagaagtttttcctgctggggactacccatggttccagctcccttcctacttctcttgaccactctacatgaatttatattaaccagagaggaggtatctaagaacattaggatagatggtgaagggagtgaaagaaaacccacccacccaccctattttgtggaaaacaccagcctagatagactgctctttgttcaggaatgaacaaagaaacttaaggtttctgaaaagattctacaacataaatggagaacatagtattcaagaggcagaggaagaaaaatacttattttaaaagtatgttttctacagaaaaaaataagtatttttgataacaatgtgctttgtgtaaggaagtatataatacaaagtgagaagtaaaagcaaattaaaaatattattgaatgagactgcaggcaaaaagtcaaagggagattgctgaagaaggatgaaatgtgaggaatctaaaaatgcattatatgtagtaaagaaaagtattaaaactggggagaatgggatgagtgatggaaaaggtaaacttgagaaattctcctgaaatgcaatggaaaaagataacagagcaatgagatgatggcaggttggacagaggattgagctctaacatgcagacaattgttcctaaagaattaaagtctagattaaaagcaaccaaattgattaagcataccataagaaaacaatacaaacaaaagcaactttctggattacagaaagacgtagaccgggccgggtgccgaggctcacgcctgtaatcccagcactttgggaggccgaggcgggcggatcacgaggtcaggagttcgagaccagcctggccaacatggtgaaaccccatctctacaaaaaatacaaaaaattagctgggtgtagtggtgggtgcctgtaatcccagctattcgggaggctgaggcaggagaatcgcttgaacctggaaggtggaggttgcagtgagccgagattgcgccattgcactccagccctggcgacagagtgagtctctgtctcaaaaaaaaaaaaaaaaaaaaaagaaagaaaagaaagatgtagaccggcagataaaatacttattctgtaccagagaaaataaaaaagagatcaataattagatctaccctgacaaattttcaaggataaagcaaggaaattaccaagcatcaggatagaaaaagtaatttaaccctcaaaggcaaagttgacattggaattctcagcaatactaaatgccagaagacaatgaagccatgtctataacttttaggggaaaatgtgactcagaaaatctaaactcagccaaggtgttatcattagtgaaaacagcagtaagatctcagttatataatttatcactaatatgctatccacatacttttcctgaaaaagttgcttaattgctagtcaattaagagataaagcaaattaaacagttcaaccatggggaggtcatgaaataaaatgattagtggtgagtagtagaaagaaacatatataataggtcgtgaaatataaataaaattcaaaacataacataaacattttgagtatttattgaaagataaaagaataacaatcataaaatgagccccaaatccaagatagggatagaaaaaaaatatgaattatttagaagaatatgcaatttaacaggctatatggtcacaactatgtcaaggaaagacatcaacaacagtggggttctaggtaatagaaatgccatatactttttcctgctactctctatttccatatttttgtaatacgtttgtatttttatagtgtgtaaactttatcaaattaaatctatgtatacagcagagttataattacagacacatttgtagtattgactgctttgttattgctctccaaattaaaaataaactaagcatttagcttaagacattaaaaaatacacaataaaacagacatcagagaacaaaaagaaaaataaatttcaaagcacaattttttgtatcagtaaacaatagttttgaaaaagcacatgccgtctgagttgagtatttaaaacaaacagaattaaacctaaacaaaaaatacagaaaacaatgtatttaaatcataaactcagagaaagtaaaatgtatagctatgctaactatgaagtgaatagtattaattagcaaaattgacttaagtacaatgctggaattggccaatatatggaaatattagagaaaactgccaaagagctactccaaatgttagtgattgtctctaagtgggtagcattatgggctattttactccctctttgtgtgtttttttttttaatttttactttttacttttttccccactacaagctactttaattctttgaacaatttttccatgcgggtaaactgttaccatattttcctattaagaaatattttcaatagattttttttctacaataaattttactggaaacatttggttcattaatttttgtctatatgaatgctgtccatcatggcttttgacaatctgagttttttttgatgatcacatttctaccaaaatcaattttcctaagtcaaattttgtatatccagattttgtaaatatttgactcttctattgatttttaaaaaatcaattttaccatgtgcatttttccttctgttgcttttattttgtttgggtttttaaaaaatcacgtttatttttttgcttgtctcaaaaatttttaataagcaggtatgaattttgaagttagatatgaataaaaaccaactgaaaaagcaaatccctctgtctcccaagacaaagtgggcagtttgtttcttttgagctttaaaggtagaaatagctgcctttctaaaatttaagtgaagcgaaatgttgacatgccctgaaaggactgccaaggttcagggagcctgttaatgggccttgagaggctctgtgactctggactaatggcccagggaccactaagagtaaattgaatttctagattactggctactttcacagctctctgatgcctccaggatgggagagtagacacaccaaatgccagaaaaataaatgctaaataataattcttcgaggttcaatggaatatctatcacttaagtagcaaactatttactaagtgtcccaaattttgcacatttgcattgcaagattttactagtaacatgagtaagtgaactgttctttacctcactcatggaataagtaaatgaaggttgtgctttttgatttaggccactcttgatatactacactcagaactacattgctcactccccttcctaaagaaataaaggtgaattgcaacaaggttctctcctgcatgttagaaacactgcagagtataatacttgcatttgccacacagaaatgcagggagagaggagcaggttggaaaagtagttttctcatctaaaattaaaaaaaatttttttgatagaaaaattttttttgaaaggaaaactcattgtgtgtatatcttgcttaccttgttgagtgtatacttacattttttatttaaaaaatttttttttagaaacgaggtttcactatgttgcctaggctagtttcaaactcctgggctcaagtgatccactcacttcggcctcccaaagtgctgggattacaggcgtgagccactgcgcccggcctatttttcattaaaaaacttttttttttttttttttttttttttttagagatgggagtttcactctgttgccaggctggagtgcagtggtgtgattatagctcactgcagcctgagactcctggattcaagtgatcctcccacctcagcctcccaagtagctggaattacaggtgtgtgccaccacacccggctgttgttttgttgtttttattttttttttgtagagacgaggtttcactatgttgcccaggctggtcttgaattcctgggctcaagtgatccgctcgcctcggcctcccaaagtgctggaatgacaggcgtgagccaccatgcccggccgatttttaaatttttttaaatagaattcctataatatacaaatataatacacaaatcacctacctcacttttaaaattctacatttttttaaagacaagtaggagggtgactttattcaccaagcgatcaaaagcaggctgcagaggacagggatttagattgggaaactctttgtattctatcaagctgtcttctttactggctaccttaaggcatttttgctgggaagaaaaaccttaataacatcaagggcagtttaccttaaccctcctgccatcccattgtaccccaccctaccagccagaaacagaagtcttacgaaaaggttttgaggaaaatatcctgtcctagtttactccgttccaacgaattcttcaaacacatccttgacccaggacatacgcagagttcaaatctagtctgtatgttttgttaggctaccggtctcctttcttgggaagactcctgactgtgccttttctgtttaaagatggtagaggcgatgggtgttctcccgcaagacggtcaaggtgtgggagagcgacacacctttgattctggcaatctctcgcacagtatgcagggccaggcctgggtgggcatactggcaatagcttttgggaacccagcgagggaggaagaagggagcatcggtttctacaataattctctctagcgggatctttctcacagtttctcgggcttgcccagcagaagagtaagtcagaattgccgtgaagcccacatacaggttgggaaagtggttcaacaggggctcgatgactgagtaactcccagtgaagcaatggcgatgtatcttgtggtcagagggcacgtaatttttcaagatgtgcagtaggtcttcatcggcttctcggcagtggatcatcatgggcttctttagagagacggccagccgcagcagtctcttaaatactttctgctgctctgggatatgcgtggtgcacttactggagtaatccaagcccatttcgccgaatgccacagccttggggtgtcgtaaggcttttaaaatacttctttcttgatagttgttataataatgggcaaaatgagggcgacagccaaagaccccccaaaccagatcatctttcaactgatcctcccacaggttatcacttaggttttgaggattgcagaagcaagaaatgcagccctgaaactccttggggaaggtgttgctataaatttttctgaatttggtaaaggtgcctttgaaaggcagcctggaatatagcaagtctaaatgacagtgggtatcaatgaaacccggttgctctggctgccagatggtccttggcggaaagctagatgcacgtcctccataaggatgtcctaatgtctcctcttgatatactctctcctccttcgcctctgcttccacatttctggagtagtaaaataaggaagaattcttggatctgccttcctctgtcatcttcagatctctggatgtgttttcggagctcactggaaaactggtggaataatcactcaggaagctctggtggctgctcctctcaccctggaatatgttgttgttgcttctgctgctgctgctacagctgctcttcccagcctgcaatgtgttactgctgctgcccaaggagggatagcaagaagacttggtactgctgaaccaagagctggtgtagtcatgccaaggactataatgaggtggaaaagtggtgtagtcagtggcgtagtatggaggctctgacactacaggaagacacagtgagaatggcttctcttcagagaatatgactgtggttccacctacatcagaccagtcactccctgaagaggggcgctcaattgccatcttttctttgtgcttttgaattactgaatgggagttatagttatccggaacatttaaaggtggagagcttttttcacaaatgactctactttggttgctaagtcgcttttggattattacatgggggttatagtcatccagaaaatttgaaggctgagagcatttttcacaaatgagtgtattttgtgttttaggtcgcccctcactgaatttctcaggaggattaacagtcaccctcttgtcacaggagctgctcatttctggggctgactctttctctttttgaggagcaaagatagtggcattcctggctggtctttctccacagtagggacactctcctaggtctgattgtgaactaatgacagcctcttcctttacttttggaatgtcatctcccaggatctcctggagaacactcagagacaatgaagagccactatcttgaggtctacccttcctgctctggaacttgtttggttcctcagtttcattttgaccctcacttccagctgtaaattgagggttcatggaattataggagctacgtttggaattaattttaaggctgtagataccctcctccagagaagccatttctttaaaaacggggctggcagagtgcactggggatcacaaggacgaaaggaactccaaatgctccaaatgaggcagtctttggagccggccctaatcaggccagtggctgaggaatgggaggagaaggaggagaaagaatttctgtggcaggatgaaccttgagaaaaacacggtgtgcaggccacaaagtagcctttaggcctttcaggcctttggggcctctctccccttccaaaccacgttactgagctccgcggggcacctgtgtttgctgcaaaccacgttactgagctctgcggggcacctgtgtttgctgggggatcctacctaagtgccgctccggtggtacttttctgcgtgccgacgggccccagagctggagggccctcacgccactccggcgcctccttttttcaactgtctatcacagttctcggtgttctagagatgccaaagcccttccacaattatttcaaagtgctctggagaagtcctaaggatccaggcctggtatggcgtccgagcccggaacgtactcctaagactgtcccaaatggtctgattttgcgctgtgcaacttcccggatgtaaaaaaaaaaaaaaaaaaaaggtacttccgtggagtcaaagtgtttccggggagtcaaagtggcctggtatggcgtccgagcccggaacgcactcctaagactgtcccaaatggtctgattttgcgctgtgcaacttcccggatgtaaaaaaaaaaaaaaaaaggtacttccgtggagtcaaagtgcttccggggagtcaaagtgcttccgatcggccgtgcgccgtggcttacgcctgtaatcccagcactttgggaggccgaggtgggcggatcacgaggtcaggagatagagaccatcctggctaacacggtgaaaccccgtctctactaaaaatacaaaaaattagctgggtgtggtggcgggcacctgtagtcccagctactcgggaggctgagccaggagaatggcgtgaacctgggaggcagagcttgcagtgagctgagatcgtaccactgcactccagcctgggggacagagccagactctgtctcaaaaacaaacaaagtgcttccgatcaaaactcttacttttggtttggaatacaaggccctttggagatgtcagagtccatgaaatgactacaagacaccttagggatcagacacagggtgcccctgggtgggcttctggcctagatgccctgatccccaacggccagctggaggacagggcagaacatactgtagaagccgagtcgggaagcctgcccagcccccatcacctcgcctgccagcctgggtcaggccagcagcccgctccatctaagagcaacactcacctccccacggccatccagcccctcctttaccacgcctcttctcactgcccagccacgtgtctacccgagctgcagccattacatgctttttgttcctcccctccaccctcagtttcttccaaaagcgtagtcatggtttttagagcatagtttaaaaacatagttttaaaaaacatagttatgactgtggtatataacaattttcagtcttgtggtgttttttttttgtttttgtttttttctttgtcctcctctcccacccccccacccccccccaccccccccccccccccgccccgagagggagtctcactctgtcgcccaggctggattgcagtagtgcgatctcggctcgttgcaacctccacctcctgggttcaagtgattctcctgcctgtgcctcccaagtagctgggactacaggctcgtgccaccatgccaggctaaattttgtatttttttttttttttttagtagagacggggtttcaccatgttggccaggctggtctccaactcctaatctcaggtgttccacctgcctcggcctcccaaagtgctgggattacaggtgtgagccaccgtgcccggcccagtcctgtgttttagtcacttaacattactgtatagcctcagtatttttcttattgcctcatgtttttcaaaaatatcatgctggtgcctttataatactccatggagaacgtagatgtgccgtaattcaccaagcccttccctttttgttaacttttcaggtccccttattctacctttttttttctatgataaaaagctgcaaagaacatctttgcacatacaagtttcttctgtattttgggttgtttctttggactacgtgcggggaaatggagttcctgagaggaggtaggaattttaaattggttcctcataacattacattgccgcagaaaattgtactaacttaaaatctcatccgtaatgagtggtccatttaataggagaaacacacacataaaccctatgcctcgttgttattttaatttgcacttaatctgacagtttcttagagtgaacttctttttatttgttgaccctctcatgaattttgtttatgctgttttcccatttctcttttagggtctttaaaaaattaaacatttttataaaattaaagtttagccatattttctaaaatgttttgttagcatgtttttgtttatattttagtatatcggagttataacttatgtagttaaatcttaatttttaaaaatgttttctttctctttttctcccaagcctgcaatgtcattcctccttctgaggcttgacacatatttatttttttggaaggtgaaaggaattgatttattatatttaagccaatacttcatctgatatttgggttggattttacaggaaggaggctatacactgatgcttttccaagttggtactttttttgcttattgatatgtgactcctctttcattatgtgttaaattcctgttaacagagtctatttccagggcatctgttcttttacacctactatgtctcttgttactgtggtattgtactactttaataaatgaactattatattaaggtataaagtctgggagagctagatttccttcattacacttaaattttacaactatctttaataggctgaactatttatcaggtagacttaaaaaaataattctaggccaggcccggtggctcacgcctgtaatcccagcactttgggaggctgaggcgggtggatcacctgaggtcaggagtttgagaccagcctggccaacatggtgaaactctgtctctactaaaaatacaaaaattagccaggcgtggaggtgtgcccctgtagtcccagctactcgggaggctgaggcaggagaatcacttgaacccgggaggcagaggttgcagtgagtccagatcacaccactgcactccagcctgggtgacagagtgagacttcatctaaaaaaaaaataataattctaagtccctccagaatgacattgaaatacccacttgaaaagttattttagtctgcttatccagaatatacttcgcctatccttttagtcaagctcttctattaatatatcttctagtaaatatttttagagttttatctgggtcacagagtttttattaaaactatttttaagtattttgtaattttgtattatgaacatactttccccccattgtatggtctagctggttattgctaacacataagaatattttaaattcaggtatggttgtactgaaatctttgttagtttttcagcctttgcctaggtcattattttatctacccataatgataatttttgtctctttcttgctaatatttttacttcatatctttctacgttgtccagagcttttaaaaacaatattaaataatgatgctagtaggggcattattgttctattcctgattttggtaggcacatagtttaattaagtattatgttagatatttaggctgttgttttaaagcagatctttttgtaatcttgttaaggaactacccttgcatttaaaaatgtatgtggtaggaaatggtgtgagatcattatatatttgctcatatttcctaattgggaaacatgttggcatctgtgagtaaaatgctgttttttttttgtgtaggtggcttgtaactgttacagactattaaattctgtttgcttgtattttacttaggatcttctgtaaatcataagtagtgaaattgttctgtagcagtagttctcaaccttggcttgcagtttgtaatcacttggggagctttaaaaattactgatgcctaggcccaccctgagagaatctgatttctgtgtgtgtgtgtgtgtgtgtgtgtgtgtgtgtgtgtatgggggatggtggatgtctgtggcgggggttggggggctggtggtggacagtgtggccaatgcatcaggatttttaaaagctctataggtgattctaatgtgtagccagggtgagaactattgttttacagttacttttttttcatggtacgtctattaggcataggaattcacctttgtagctttccatcatttttggtatcctggagagttatataatttggtaattttcttttccttgaaagttggaacaaattcattagtaaatcatcctggttggagactttattggggcaattctttggtaatttttttcactgcttacttggttattagcttattcattgtgtttttgataagtcacggttcttacagaatatcacttatttaattgcaattttaaaattcattttcatatgtttgcatgattattataagataatttatcttatggtttatatcttataattgcatctctgtcatgcactgtatcatttctcattttatttatatttttcttgatgagctttctaaaatcttatctattttatttatttaaaaagtccttggatttatttattgcagttgtttttcttctttcaaatttatatatccttactatcttttttgctttctgtttttcttatgacaaatttttgctttttcaaaaccttttgtttattgttttgaggcagtctcattctttcgcccaggctggagtgcagtggcacgatcatggctcactgcaacctctgcctcctgtgttcaagcaattctcctgcctcagcctcctgagtagctgggattacaggcatgcaccaccaggcccagctaatttttttgtatttttagtagagacggggtttcaccatgttggccaggctggacttgaactcctgacctcaggtgatctgcccgccttggccttccaaagtgctgggattacaggcgtgagctactgcgcccggccttaaaagcttttgtttgaatcattgctcactggttctaaactctggctatgtttcagaattacctggggagagtaggaaagaaaaagaaggatcttgtacttgcctatctcaaagttcatggctgagacctctataacaaaagacagattaacaagagaaaagcacacaaatttatttaatgaaagcttcaggagacatggagccttcagaaatgatccaaagaaacaggaaaaactatttttatggacagtcatgtagaactgtgactggaggacaaaaggatatgatctaatggtaataaactggggggaacttataatagcaagatttgtttgttccgatttttattcttcatccttatgtgacactcctttcctctgggtatagggcaggacacctgtcacatgcgagtctatagggaaggaggaagggagaaggtcagagaatgaccttcctaggtgttatgacctgcctccggggagaatgatggaagaaggtcagagagaccttcctgcttctgcctttttctcaaatgccaaggtgccatgtgcctcggcatatttgccgaggtagcatgtcctgaaccccatcagtagcttttaaaaaatagtaatagtcccctccccaaggttctgatttaacttacttaggcaagggtctgggttttttgtttgtttgtttttcacggaatgtcactctgtcgttgctcaggctggagtgcagtggcgtaatcttggctcactgcaacctccacctcccaggctcaagtgattctcctgcctcagcctcctgagtagctgggattacaggtgtccaccaccgtgcctggctattttttgtgtttttagtagagattgggttttgccatgttggccaggctggtctccaactcctgacctcaggttatccactcaccttggcctcccaaagtgttgggattacaggtgtgagccattgcgcccggccagatctggtctttcaaattttttttaaagttcccaatgcatagccaaggctgagaaacactgttagcaatttatcctctctctcagactctaaattcttttatgtaataattttaatccattaatttaccccagattgcaaatttgcctatatcctataggtttgtatggccttatattttattatatacttttatataaatttattacatacatgtatataaattttatttgtatattttttatatttttagatttatttttggtacaattatgaggagtgacaattttcgtttataggtacattatacacttctagttgtattactttgtgatcagtgaatataacttgtataatttttctgtttttaaaatttattaaaatttttgtgaattagcatatgtttcagatatatttctgtaaatatatatattgtcatgtataaaggagccatcctctatatgcaacacaaaatgtattatcgtttatttccttgattatgggacttcataatcatgagagaaaccattgatttaataacagctttttcaggaagaataaacaacactgtattaaatgtacacaaatttttcttgtctactaacatatagagcatgcatttatccttaccattatatcccttttatagtacttcacaatttaagtctgaacctttttcataaaacagagcttaaacatattaaacttggacatgtgatgttgacctctttataaaatgttgaggttattgaacattgccgatgttttgtctttctttcctgacagcttctctagaaattcagctgtaagatttttttttttttttttttttttgagctggagtctcgctctgtcgcccaggctggagtgcagtggcgcaatctctgctcactgcaagctctgcctcccaggttcatgccattctcctgcctcaccctcccgagtagctgggactacgggcacccgcccccacacctggctaattttttgtatttttagtagagacagcgtttcaccgtgttagccaggatggtctcgatctcctgacctcgtgatccgcccgcctcggcctccgaaatgctgggattataggcgtgagtcaccgtgcccggcctcagctgtaagtttttgacattagatgtttgattcctgaagtgatagtctttctgactcacgtattggccacatcagcctccccatctttaaaaattatatgctttattctaagaaattaggcttttgcctttgccttacagttgcatggtctagcctgcaatggacaaccttctccacgcaattattttttgtgtcatactgcatcagacaataatcattttcaaacattttaagtgaaaattaagaatctaatgttaaaatccagctgtttgggatatgcaatgctaagcaaataactcaactgtcatgaagataggatagattcttctctacaaagctaaatttgcaccatatatcaagttagaactacttcccatcaaaatgcattcttgactgctttgagattcttttggctttaattgtaagaagatcctgaattcagaaacattaacatttaaaatttttcctttgtaatgaggaaatcatatacctgttatttaaagctaattgatttcagatttcaggagttttttctttttcttttttattttcttttctgtttttctgtcacccaagctggaatgcagtggcatgatcatagcccagtgcagccttaaattcctgggctaaagcaatcctcctgcctcagcttcctgagcagcttggactatgaggcacgcaccaccatacctgactagttaaataaagaaaaattgttggagagacagggacccatgtgtcacccaggctggtctagaactcttggcctaaagtgtttcaatcctcctgatgtagcctcctaacgtgttgggattacaggcatgatccactgtgcctggtctaaggttttatatcctctaggctaagattaaaattccaaatgccttgaggatcaggtaggtaacctcatataatatcatagggcctgcagagccagagaggcctgtggaggactgaagatcacatgcccccaccaaatgatatttatattccgttttcaagaaaattgcagccaattacatcctctaggaccttatttttcttttttcttttttttttttttgagatggcgtctcactctatcacccaggctggagtgcagtggcaccatctcggctcactgcaacctccacctcccgggttcaagcgattctcctgcctcagcctcttgagtagctgggattacaagcatgtgccagcacgcacggctaatttttgtatttttagtagagacggggtttctccatattggtcaggctggtctcgaacccctgacctcaagtgatccacctgcgtcggcttcccaaagtgctgggattacaggtgtgagccatcatgcccggcctaggaccttatttatctagtttctgcttgacatcataaatgatgataacaccttacatcataattatgttcctataaattttcatttttaacagtttttattttaggttctgttttctggattctctgatacatcaagttccattgcaattagatcatttatttttgtgagatcactttttaatctatttggtgtctctcctcttacattctacttcaccacattttataatttcctcttcctcttccttttttatctttccatctctacctcattctgacttgctctgtatctttcatgctggagtttgacagccctgtattctcatgggagcagactatgaaatatcagtctgtccctcatctagacatattgaagcccaacctaagataatgtctttccttttctctttatttcaatttagcatccttctcttttaatgcatcatttgattgataaatatttaatgattacatacatgacagttgacctatgccagttgtcaattgacctatgccagtgtagtcattctcaaatttatactggcagcattcagtatatagaggtgggtgacagccaagaatattctctctacactttcctacttgattacaaagaaaaaaaaatctcagattaaatattacgtacactgaaagtttgatgaagccccagctctttctccttttaggtgttccaacatctttttttcctcctccttttttaaaaaaaattatttttgagacacagagtctcgttctctcacccaggctggagtgcagtggcgaggtcataactcactgcagcctcgatctcctgggctcaagcaatcctcccacctcagcctccctagtagctgagactacaagtacacgtaaccaagcccgactaatttttaaatttttttttgtaaaaacggggtctcattatgttgcccaggctggtctcaaactcctgggctcaagtgatcttcctgccacaggcctgagccactgtagccagctccctccccctactttttaaaagttgaaatataattcacataacaaaaactcaccattttaaagtgtccaacacaactcagtgtctaatatctttttttaactgaggtaaaattcacataacatgaaattaaccattagccattttaaagtgtgcaattcagtgacatttaacatatccacaaggctgtgcaaccatcacatctatctagttccaagacttttttgtcaccccagaaggaaactctatacttgtccaacagcatcttatctgaaatattcactcaatacaaatgtgacagcattctagcaatggggtttagctaacctaattggagtcaggccagacaaattctttaagaaagcagctgaacataggactatttgggaatgaagccaaaggtgccatcctgaagggagtagatctctgggttcaccagactcttataacctgttcctgtaaggacagtgcctggttagtatttgtaactgatatgtgcattttgaatacaatcatttcactaaaatttattctaatatcatttatggcaattgacaaagcttcttgtgttgatcaaagaaaaagctactgaggcattctgttagccacttctgaagtgtgggcttctgataaaaatatgctaaacactcctggagtatatattcttacttaggttaactgaccaccacccctagagggtagattgcatctaacagactcactcatatatatcatattgtccacattgaataaccctggagttacatcatatgcacagttaagttttgcaacttcaattataaaaattgatcaaaagtgagagacaaagagaatatttaaatggagctctcacagagcttgagccgcaggtcaagcttgaaatggtagcctgaatctacttttcccacagttgtcctcaattaccttgtcgtgctcagtgtgtgagcaggatgccatattaagaatgtttccaatggctaaagatatatattattcatacaacatggcacctaagcataaagaaatgattttaactggtcttcaactgaagaagcaggcagtcatctgcttcaatatgggagaaaaatgggctgtgttttacttactgagaggcacagttttctaaagtagttaaggaattttcaaagatatttttgactatctctgaattttaccataactgctttagaatccacctgtccttcccttccttattccctaccgcccccatacaagatgagtctgagtctagcattgggctaggctccttgaggttcccgaagtgtaaggtggggtctccagggcattggatgaatttcagatatgcctgcttgaattgcctgaaggcaagcaatcatcaggactaacagtcaggataattttatgccagaaccaaggcagctttgtgttattgttaatgggaaaaaaatgacaaaacttattcatcttgtgagaaagaatattttgtctctataacatatacatttagaatcccactgtgaaatcccaaaggcagactctagttcagtttatggtagagctgaacgatggatgtattacttgaatatcatttccttgttttaaccagatggtgataaaagtattaaataatctttatgtattgtatcttagattgtatatccattcgcatggctgatgtgtagaatgagttcttggaaaaattctctctacttttttctttatattaacaaaaagtatacaggcagctgctttgttaattttaagtttgctgaattttcttttcatttcttagtttctaattattattccaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaaggtatctatttaaagcagagttatggttccttcacttctgactcctgcctttatatactgcctgcctttagcttttcaaaagactgcatgctactgtttaggctgtctaacctgctggcagtggtgaatataaacatgccattagcgtgtagttattgattgtgacttaccagctttctaccctctgcatgtcaacattggctgggtctctcactcctccgtggcatacttgtatcctttcaggtgctgctctggtatgagtaaactctcctgtgcctttgactttttcctcaaaccctttggtcgccttgccgtgagcagatcacttccttcacaacaccattaggggagaagagaaagctgttctctactgcagcttccagattggcattctcttctttcttgaatttactgtcatttgtttcaaccaccccctcctcatcctcatacctgttaactacagacttcgatggtacctcaccagagagtcattgttccttcaccctgtgtatgccagtcatctttgtccatactcctctcagccacagataagagttaactctgtgatgtggccaccagagaagctaatcctaggttgcattaagtatggcagagatcaatggagatgactgatttcttctgtttgtgctgtgggtccttctcttgggatgctgcggagttctgaatgacttcaggggacagcaactatgacggtgaaagaactgaacatttgtcatgtgcaagacagaatagtgaaaagggatatttgtctgtaatggggagactccagtgtgcttgataaatgtcctcaggaatctaaagggctgtcatgtggagaaggggtgaccttattctctttatgttcatggatgggacctaggggtcagagttcaggtcagtaagaggaagaactttctggcagagagctgctagaagttatagggaatggacctgggtagggttggggttaggggtctggtgtaggggcggaggagaggagagtcacagatttgtttgttccctcgtgtagatagatggccctgggggcaggtcaggggtggtttttcactgacagcctgctggaagtatgagaggatttgagtgtttgtttggttgctggtgtaaatgacctttcagggtactcagttccttgacgagctgattcttgggtgtgttgttgtttctttgccttttagagtattgccacctccagtatctcagtctctgaaattgtcttctctaactacaatatatactccttttactttccctacttgctcataactaccatccctgttcttcactctcctagaaaaacatatcctgaatatgtccatgtctttccatccccttcactaccatcctcacctaagctaccctcatctgttgactagaggaatagaatagctgcctaacgtggtctccctgtttccattcttgctcctcctacaatctgttctgtatgcagcagggagagtgttgtgtgggatgttacctggatacagtggtggcctttgagaattgtacatgcaggctctcccagaggtcacaaaacagaaggctcatggatcacattaaaatgcatgaatcacatgttacattaaagtaatttaaaacacatgatgagaagaaagagggaaagagatagggtaggttcacacacttgggacagggtacaagtaggcagaaggaccatactgcctgaatcctggggtcagcaatggttctgtctctgtttcactaaccttccctgctactagtatggtttagagaccagaactgaggttcaagcaaggagaaccacagacagaaggggcttcgggctgagggcacacacttgctctgttggggagatgcagggagaagtgtgcctggccatggctgtagcttgtcaataagcctgctggatagtcttgggttttgtttgtgtttcttgggcagaggtcacatggggctagaatgggtgtcaccgatgaatgagtggccaaattgaggcctcataaatattgggtgctcatgaatatttagtgtccttatatatttagcatatcatgaatatttagagtccaggtgcctcatgtatatttacgacctactgaaaatcagttatcttttggtttttccatccctttctttctatgtttaacatgcccatgctctacttagcatacctacctacctattgttatttaacacatctcatgatttctgcctatgctgaacaaattttgcttactaattactaatctaggcctgagggctctgtattgatataccacaatgagttcaagggggagaagcagggatttgagggccatgggctctgagaataaggttgtcatgcaacctcattaagtgtgcagaggacttccttcaatgctcatgagattgaggtttttcttagagcatggcttcattgtgtctggtggttggaataatgaatttggagccagccagcattgccaagaagtatttgttggatgcctattctgtgtcaggcactgtgctatgttttgggaaaatggacaaaaggactgagtcccatcatagccctatctcatggagtaataataggccaccagattggaaaggaaagggagcaaggccaccagtccaagagttttgcaattgttcaggctagaaatgctgagtgtccaaaccaggacaatgatggtaggaatagaaaattggggaaggatttgagagacatttggttggcagagttgatatgcattggccagtgattaaatacagagagtgaggagggggaatatctaatgaaaaagtgcctaccttatcattatctcatttaatctcctgatgaccatctaaagtagttactgtcactgtcagcttttacagaaaaggaaacaggcttagggaggtaatttgctcagtctgttttgcattgctctaaaggaatacctggggctgggtaatttataaagaaaagaggattatgtggctcacagttctgcagactgtacaagaagcatggcaccagcttctgcatctggtgaggcctcaggaagcttttactcgtggtggaaggtgaaaggagagcaggcgtgtcacatggcaagacggggagcaagagagaaaggaggggatgccagactcttgttaacaatcagattttacggtaaccaacagaaagaactcacacattactgcgaagacaacacaaagacattcatgtgggatccacccccatgacccaaacacctcccagcaggccccatctccaacactggggatcacatttcagcatgagatttggaggggacaaatatccaaactatatcggcctcagaggtctctgtggttgagtcatgatacctttataaagcccaggagcacagagcaagaaacaggattggggtttgaatctggggtgtgtttcagggcatgaggcctttgaaggggtgttagacatctgtgtggtgatgcccctccaggcaggtacaaacttaggatgtgttttcaggaaaaaagtcaagactagaaatggagattgggaatcagaggtgcccagatcatgaccaggctattctaccatgttagaggagagccactggtgaggtgatggaaagataaagggaattcaatttagtgtctctgcttggttttactagtggtgggaaaagacgaagattagtatgaggaggtaatatgaactgtcctcattgttctttgtgttccaactgatacactatccactccctggccattttatttggtgaatttggcctaatggtaaatctttcaggaaatatggaaataccataacattttaaaaacaggttttcacaaattttaaggttaaaagtatgacattttattttacaaagggacaagaggttttagattctttagggtcatttaaaacatataaggcagtttttaaagattggcaagaatgcattagaaaatggttgaagattatttaagaacaaagaatttacaatttataatttttgtggacatctattttacttacgtgtatttgattatataatagtattgctgtggcaaaaagaaaaaatttcttacaggttttcacctaaacattttgttctgatattccctcactaagctctgcttattttctgattactttcccaccatgacaccaaacttgcacaaatgatagactggaggtcacaggacaccccaggcctgggttagtgacttgcattattgttttcattattacctttaaagtgaaagctcataatcctatagctcactggcccctgtccagttcatcttagttttattaaactatccaagaagaaatatgaaatgtagcttcttttagaatcttggaaaggcttttattaagacttctcaattctttcagactcttgatttcaaatctcacataggcagattccaaaggcaagctgaagatagtcataatgatgtacttgaaaatcattcttgtgtaaggagggaggaatgctatcataaagtctcagaaaaaaaagacctgagtaaaagacaactttaaagtctctggaaattttccgaatttttgattggctcactgtggtcaggacatttccctgtgtgaagacacagctcaagagttgtgtatagaatacacagtaatcacgctgcgtaatgacattgaatttgtcagcagagtagagaaatttggaaggctgtagcaaatcctgtagaaagcaaacatgaataaccactctgtcaccaagctttgtttagagagaaaccagtctcttgaaatatttaatatgataattcttgttaaggaaggtctatttggactgcagatagtttgaaaaatcatttaaatgccttcttcaagcttttctaaattaagtgattggaaaaaagaaaacacttaatgagccagtggttcagacgtcagtgggacagggtaggtagtgtttctttcagttgtgacttgagtggcccgggcttgctttccatgcatctgggccctgggaagaggcaaatggtcaagattaggtgctgtgcagtgatggcgttcctgtcacttccataggattttgatattttctagatgaacttggaggtcagatgcacttgtttcttgtgtgaccatttggaaattagtgcaactggaggaattataaccctcccctgctcccttttggttgcctctattatcatgtaattttttagggtggggggagtttggaatcagccagaaacaaaagaggcatccattagcatggtaccaaaataggcattcatgcagcttctaatcagaacaacatatttttaatattcacaagttcttgttggcaaggagatttgtgtgtgttatgagtcaagaaagccagtattgcacttcaaggcttgctttcatttcttgccaggacatcactctcttttcggttagatgtgttatatttacagaacgtgttgcttttctgctggaatgtagttaaaacaacattatatcaagccaagaatgtcagaggttaatccagtagttttacctctaattgtctaacagaataattgtcagttaaatacaccaagtccagcctaatctgtgctaaagaaaggataatgattagaaatgtgccgtgattttctggtatggtctataccagttgttctcagttgaaagtgatcctcagaatctcctagcccaccccagaattttttcttctgtagacatggggtcaagaactggcttccctatgattcttagtgcatcttggttgagaacactgatttccactaatgacttgttttggccccttaataaggtagtatttctcatatatatattttttaatactctaagataatctgcttgatcaggcaaatgtaatcacacaaaatagaagtcagtcattcatatgccattcactcttattgggcatgtactatatataggtattatatcccataaagtggtggaggggtggtgggaaggttgccagatgaagtataagatactcagttatatttgaatttcaggtaagcaatgaagtttttagtataattatgtcccaaatattgcataggacatagttatactaaagaatttggctgggcatggtggcttacacctgtaatcccagcactttgggaggcagaggcgggctgataacttgaggccgggagtttgagaccagcctgaccaacatagcaaaacctcgtcgactaaaaatataaaaattagctgggtgtggtggcacatgcctataatcctagctactcaggaggctaagacaggagaattgcttgaacctgggagacggaggttgcagtgagccgagatcacaccactgcactccagcctgggtgaaaaaaaattaaaaaaatttaaaaaaaaaaagaattctttgttgtttatctggaattcaaatttaactgagcagcctatattttaatttgctaaatctggtcaccctagagggtggacactggggagagaaccaggtacttgagggattagaggaggaaaagccaatatccactagagaatctggcatttgaatggtacctcaaaagtttctctagataaagatggaagagaaaggcagaatagtcaaaaggagcaacatgagataaagtggtgggacaataaattgggaagtatttgggagcagatcatagattgaatagggaaaacagggcaagaaggtggtcatgcaagaggacattaaagcatctgttattttggtgctttttcaatagctaagggggagatgcgtagggttactgtttcttattgtgagcagaaatgtggaatttttaacttcttattcttttgctgcaaggtgagtgcccggttgtgtatataaaaataattattcttgtgaaaccgaaactctaaaggtgacattttagaaaaataaaagtaaaagtatacaagtcattttagtagaggaatatagtaagcacaagaggaagaaaagacactctgttatgtgtgattgtggttaagcctcttagtatttttagggcacaaacttgtagatgtgatgataagtggcaattgcagttatatcttcatttacctaagaaatatctgcctttagacttggatgtactctaggcctgcagcattactaaaatgaaattaacatacttaaattaaaatagaggtgacccaggtgcagtggctcacgcctgtaatcccagcactttgtgaggccgaggcaaaaggattgcttaagtccaggagttcaagaccagcctgggcaacaaagcaaggctgtctctacaaaaaataaaaagttagccaggcgtggtggccatgcccgtaatctcagctacacgggaggttgaggtagggaggatcgcttgagcctgggaggttgaggctgcattgatccatgatcatgccactgcactgtagcctgggcaatgatgtgagaccctgtctcaaaaataaataaataaataaaaaataaaatagaggtgagagtttggagtcttaattctggaaggtgaattccagaaaagtaaatttagtggtatgagcaaagatctaaggcaagtctcaactgaataacatgaaaacacatgaaacataaatggatatatggtcactttgatctaaaccacagggaaatgttagaaagttaaagcttgaagagcatagccagatagcagggcttttacaaaggaagagaaatgtaaaacatgaagatgaggaaaagctggacatgtgtcccaatagtctttattgggcagttaagataaactcctgaaaatttaaagggcaaatatggtgctttagttgtttttctgttttgtaacaatatctttatttatctaccttgatgatttcacctgctcttcaatgtgggtcaaggacatggtatcctgcccatttctttgatatcccaaaacaaattcctgctgatggagtttctgccatttatcgtggaagactaaaaacataaaaattctgataattagaaattttaattctcaaaggacacagttgagaaatcctatgaatatgttattgaaagctctcatgtgcaactgtacatttcaaatggcccaccttggttttctgattaatatggaattgtgacgttagatttttggttatcaaaactttactgttagtgttagacctgccttttctttctaactcatgggtgttcaggattcttttttgtcaccaagaagagcttccctggccttttctgagaagcatctagtgagagaagtgtagcggctaagagaaggaagagttggggggcttgagatctgcaggctcctgggagaggcaagtcagctggtggggcaggccctgcagggtgcattgccatagcagtgggtgggcatctctggaaatttccccttcgaggagagaggctgttctttcggaagagcagcttcatctctcttttcttttcatggtggctggtagctcttttatccatttccatcctgttatgcctatggctcttcctcctcaagtaatatgtagctgcagtacagtgagatacagctcagtgcaaactatggaaagtaatggtatttagttagagtctgaaagcccaacttcaagatcttttactgccatttgttagggcatgaccttgggcatggcatttaacctctctgagctttggttttctcatccttaaactgaatattcatatttcatgtattatctgccttatagaattattgaggattaaatgagaaaatgtaagtgaaagtttatcctagggctatgatgatgattgtgattagtattatttaaaagcccagtgggtgggccagtttttgccacctagaaaaatataggactcctattcaaagtcttatggaacaaaaatcatcgctaacttgcttatttgaatttctataatgaagtaaaaatgcaagatagatggaatttttgaagaagctcctgactgttgaataattcttatatattttaaaaactgtcacaatataagtatttttaaagtagtatataatggttcctgaaaatacctgaaatgcccatccttttatacatgtttaagtatgcaatttgttctaaatgtctaatcttgaatgattaaataatttgcatactgttttcagtgctatgaattaaaggctaattgaagtataattttttcacagtaaaattgtatcatcttttatgtagtacatttaaaaatattctaggccagttctaattttatagttttattattttaatttaatgcaccaagtaattaaaaattgctgcaaagaaaagaagctgaaaatgattttaggtaatttcccctcaacagagtgaaaagatgataagtagaataatggaagagagcccaacacagttcctggcacataaagatattcattaaatattccttaatgaataagcaatgactaatttctaagtgtctctagactttgagaaaaggcaccattttcagtgctgtataaaatacaaagaagataggttgacatctttatattaaaatacctccatgcagagttcccacaagccaatttttattgaatcattagatctgcagtttgttctgctttccttttctctttgttcttggagtagattctcaggcctaagtcagttacagatattgagagacaattctccatggtatcatgcatttctgtatctcttgtaagcagaggcactgacttctctttgttctggactatctcttcaaggatgtttatatagcaagtagctgtggaagacaaaaatagtctctccctctggagcaaagtataggtttgcttatagcgttggaagatagaggcttagtgtctccttccagtctaataaagatagtagctcccttggagataaagagcagggatgcttattgctaattatagaagatttgggttccctaagctaagggttactctcctgtaatgtaacccactgcatgtacaaatgttacctggcccttactatgtcatcctgtgggaattggggcttaggaaactggaaaaagaaatgctgatatttaggctattcttactgctgttgattaataaactgccttttgtctctgaccaaggcacctcctgtcttctaccagcatccatgaaactatggaaggctaacttctcatcttgcaagtaggataaaatctcaaacccttttttctttttttcaaattcttttttctttttcttttcttttctttttttttttttttttttttttgagacagggctttgctctgttgcccaagctagagtacagtggtgtgatcatggctcactttagccttgacctcctggactcaagcaattctcccacctttcagcctcccaagtagatgggaccacatgtgggcaccaccatacccagctaatttttttttaattaattttttttttcttttgtagagacaggattttgccatgttgcccaggctggtctcgaactcttgggctcaagcaatctgcctgcctcggcctccaaaagtggtgggattacaggcatgagccaccatgcctggcccctaaacaatccttaacaacagattgcagcaatatttgggtaacttggctggtatggtgtggtatagttggtacactcatgtaggcaaggaactcttttacctccagtggctgaccactcttttggatatacgtgggaccctgggaacatattctcaagaggagaaatgaatgggcatcagggttggaagtagaagatgggatgagatctagagcttttggcccagagcactggctagaactgtgaagcctctgataaccctcacttgaggtagtgcttgggtggaggtggacagaggctatagaggaaggaggaggaaaaataggttgatagaggaaagaagattccatgaaacttcacagcagccaaaagtgattcatccttattgaaacttctaagtcaatgttggcacctatcattccaaagcttactagctttttttttttttttttttttttgagccatgagtacacatttttgtgagcattctgcattggtgccttaatgcctgttgagtgtgctcacattgagtgcttgctggtggctgaatgtgagcaggcttgttctaggaaaagacatgatggcagcgtctggtatttttcgtcattctgcttatgtcccctgtccttcatcccccatcctcaccccagtctttatggtttattaaaatacttcccaagcaccacttaggcaactctaaccacatgcaaggctggccacagagctctgaacctcagaaatctcagctcattctgacttcctcagagttggaatgtactaatgctgcttcctagaacgagtcctttgcccagttttctgttgcgggaaagtattcagggttgttagtgaatgtgctgtatcttcttacttgttagccacatgataaaacagttgtattttctttcatgccatagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggtaaggaattgacgtttgttgagttcttgtcttcaaaataaaaatccctttggaaagtcagtaaagggtgtttgtactcctgatgcagatgtgaaagagcttttagagccatagttattccagttttgttcttctttgggctagagggaaggctgagtgttagccacagagcaagaatgacttcctcactgcctcaccccaattctctctgtagagactctctctttcaggcagtaggagtcttcagtgaactgcacaggtgagacagattctaggcacccacaattgactttgtggtcactgatggtatatgagttgtatccacatttccttggcttgtgtttttgctttttagttgtctaactctggctagaaagatctttgcttctatactagtgatttagtgaagcaagccttgggtacacattttttcttcctcctaggaaattccaggtcctcttaggatggcattggatgccaagatgctctggaagaataaggaagaccatgattctgatataccccctttaggaaaggatgtttatgtacaaggtctgaccccagctagtgtaagggagtaaagactcaatatttttagtattatttttgtcttcctattttttaaacagtccctgggcccaaattttgttttccagaagaatttgaacactcaaaggggggtggaaggtgacaacacccagctaatctccttgctgggactggatcgcaaatgtcttgactcttaccctgatttccatcattgtcacttgtttcctttttccttttctattgaagtgtgattacacacagtaaaatacacagaaattaagtgtacagttggatgagtcttaacaaatacacgtacccctataacctacccccatattgagatgtagagcatttctcttcccccagaaagtcccctcatgtgtttatcgaatcgatcccgctccccaccacagacaactgctgttctcatttctatacccatagatgagttttgtctgatttttattgttttaaaacttatgattcatttccttgcagagaggtaacaaaatttagaacaaaattctcttttgattctgttttgatctctttttaaaagccacttgtaggatcattcatctattcctgcctcccagccccagcagaattattctttaatgttgttgtaggcatacagccctctggagaaatatatatattgttgatcctggaatatctaaggtgaaatgcctgtatattgatgtacaaagggattttttttggtttggattcatttttattttttccaaatgccctggatgaaagagtctagataaatagaaagaatttagaaccagcagagagaacttgaaggaaatggatccaaatgaattgccaccctttgcatatggctgcagtcattcactaacagttgttgttatatgatagtgattgtgaataatgatggattatatgaaaatgcgcagagcactgtgggatttcataggtttatgaagaaaaaaatttatgtatatttaaaattatactttaagttctgggatacatgtgcagaatttgcaggtttgttacataggtatacacctgccatggtggttttctacacccatcaacccatcatctactttaggtatttctcctaatgctgtccctcccctatccccccaccccctgacaggccctggtgtgtgatgttcccctccctgtgtccatgtgttctcattgttcaactcccatttatgagtgagaacatgcagtgttttgttttctgttcctgtgttagtttgctgagaatgctggtttccaacttcatccatgtccctgcaaaggacatgaactcatcctttttaatgactgcatagtatcccatggtgtatatgtgccacattttctttatccagtctatcattgatgagcatttgcgttggttccaagtctttgctattgtgaatagtgctgcaataaacacgtgtgcatgtgtctttatagtaggatgatttataatcctttgggtatatacccagtaatgggattgctgggtcaaatggtatttctggttctagatccttaaggaattgccacactgtcttccacaatggttgaactaatttacactcccaccaacagtgtaaaagcattcctatttctccacatcctctccagcatctgttgtttcctgactttttaatgattgccattcttttttttttttttaaatggagtctcactctgttgaccaggctgtagtgcagtggcgcgatcttggctcactgcaaactctgcctcccaggttcaagaaattctgtgcctcagcctcctgagtagctgggattacagaggcctgccaccacacccggctaatttttttttaaatatttttagtacagacagggtttcaccatcttggccaggttggtattgaactcctgacctcgtgatccacctgcctcggcctcccagtgatcgccattctaactggcgtgagatggtatcttattgtggttttgatttgcatttctctaatgaccagtgatgatgaactttttttcatatgtttcttggctgcataaatgtcttgttttgagaagtgtctgttcatatcctttgtccactttttgattttttttttttttgtaaatttgtttaagttccttgtagattctggatattagccctttgtcagttggatagattgcaaaaattttcttccattctgtaggttgcctgttcactctaatgatagtttcttttgctgtgcagaagcttgttaatttaattagatcccatttgtcaattttggcttttgttgccattgcttttggtattttagtcatgaagtctttgcccatgcctatgtcctgaatggtattgcctaggttttctttagagtttttatgattttaggtcttatgtttaagtctttaatccatcttgaattaatttttgtataaggtgtaaggaaggggtccagtttcagttttctgcatatggctagccagttttcccaacaccatttattaaataaggaatcctttcctcattgcttgtttttgtcaggtttgtcaaagatcagttggttgtagatgtgtggtgttatttttgaggactctgttctgttccattggtctatatctctgttttggtaccagtaccatgctgttttggttactgtaaacttgtagtatagtttgaagtcaggtagtgtgatgcctccagctttattctttttgcttaggattgtcttggctatacgagctcttttttggttctatataaaatgtaaagtagtttttttctaattctgtgaagaaagtcagtggtagcttgatggagatggcattgaatctataaattaccttgggcagtatggccatttttatgatattgattcttctatctatgggcatggaatgtttttccatttgtttgtgtcctcccttatttccttgagcagtggtttgtagttcttgaagagatccttcacatcccttataagttgtattcctaggtattttattctctttgtagcaattgtgaatgggagttcactcatgatttggctgtctgtctattattggtgtacaggaatgcttgtgatttttgcacatcgattttgtaccctgagactttgctgaagttgcttatcagcttaaggagattttgggctgagatgatggggttttctaaatatacaatcatgtcatctgcaaacagagacaatttgacttcctctcttcctatttggataccctttatttctttctcttgccctggccagaacttccaatactatgttgaataggagtggtgagagagggcatccttgtcttgtgccagttttcaaagggaatgcttccagcttttgcccattcagtatgatattggctgtgggtttgtcataaatagctcttattattttgagatacgttccatcaatacctagtttatggagagtttttagcatgaaggggtgttgaattttattgaaggccttttctgcatctattgagataatcatgtggtttttgtcattggttctgtttatatgatgggttacatttattgatttgcatatgttgaaccagccttgcatcccagggaggaagctgacttgatcttggtggataagctttttcatgtgctgctggatttggtttgccagtattttattgaggattttcgcatcaatcttcatcagggatattggcctgaaatttcctttttgtgttgttgttgttgttgtgtctctgccaggttttggtatcaggatgatgctggcctcataaaatgagttagggaggagtgcctctttttctattgtttggaatagtttcagaaggaatggtaccagctcctctttgtacctctggtagaatttggctgtgaatccatctggtcctgggctgtttttggttggtaggctattaattactgcctcaatttcagaacttgttattggttggtctattcagggatttgacttcttcctgggttagtcttgggagggtgtatgtgtccaggaatttatctatttcttctagattttctgcatagaggtgtttataatattctctgatggtagtttgtatttctgtgggatcagtggtgatatcctgtttatcgttttttattgtgtccatttgattcttctcactttttttctttattagtctggctagcagtctatctattttgttgatcttttcaaaaaaccacctcctggattctttgattttttgaagggttttttgtgtctctatctccttcagttccactctgatcttagttattttttgccttctgctagcttttgaatttatttgctcttgcttctctagttcttttaattgtgatgttagtgtgttgattttagatctttctcactttctcctgtgggcatttagtgcttataagcactaaatatataaatttgcctctaaacactgctttagttgtgtcccagagattctggtatgttgtgtctttgttgtcatttgtttcaaagaacttatttatttctgccttaattttgttatttacccagtagtcattcaggagcaggttgttcagtttgcatgcaattgtgcggttttgagtgagtttcttaatcctgagttctaagttgattgctctgtggtctgagagactgtttgttatgatttccgttcttttgcatttgctgaggagtgttttacttcccattatgtggtcaactttagaataaatgtgatgtggtgctgagaagaatgtatactctgttgatttggggtggagagttctgtagatgtctattaggtccacttggtccagagctgagttcaagtcctgaatatccttgttaattttctgtctcgttgatctgtctaatattgacagtggggtgttaaagtctttcattattattgtgtgggagtctaaatctctctgtaggtctctaaggacttgctttatgaatctgggtgctcctgtattgggtgcatatatatttagtatagttggctcttcttgttgcattgatctctttaccattatgaaatgcccttctttgtcttttttgatctttgttggtttaaagtctgttttatcagagactaggatagaaacccctgcttttttttgctttccatttttttggtaaatattcctccctccctttattttgagcttatgtgtgtctttgcatgtgagatgggtctcctgaatacagcacactgatgtgtcttgaccctttatccaatttgccagtctgtgtcttttaattgggacatttagcctgtttacatttaaggttaatattgttatgtgtgaatttgatcctgtcattatgatgctagctgattattttgcccattaattgatgcagtttcttcatagcatcaatggtctttataatttggtatgtttttgcagcagctggtactgatttttcctttccacatttagtgcttccttcaggagctcttgtaaggcaggcctggtgatgacaaaatctttcagcatttgcttatctgtaaaggattttatttcccccttgcttgtgaagcttagtttggctggatatgaaattctgggttgaaaattcttttctttaaggatgttgaatattggcccccactctcttgtggcttgtagggtttctgcagagaggtctcctgttagtctgatgggcttccctttgtgggtaacccgacctttctctctggctgcccttgacactttttccttcatttcaaccttggtgaatctgacaattatgtgtcttggggttgctcttcttgagaagtatctttgtggtttcctctgtatttcctaaatttgaatgttggcctgtcttgctaggttggggaagttctcctggataatatgctgaagtgtgttttccaacttggttccattctccctatcactttcaggtacaccaatcaaacgtacgtttggtcttttcacatagtcccgtatttcttggaggctttgtttgttccttttcattctttcttctctaatcttgtcttcacgctttatttcattaagttgatcttccatctctgatatcctttcttctgcttaatcgattcagctattgatacttgtgtatgcttcacaaagctctcgtgctgtgtttttcagctccatcaggtcatttatgttcttctctaaactggttattctagttagcaattcctctaaccttttttcaaggttcttagcttccttgcattgggttaaaacatgctcctttagctcagaggagttagttattacccaccttctgaagcctacttctgtcaattcatcaaactcattctccgtccagttttgttctcttgctggcgaggagttgtgatccttcggaggagaagaggtgttctggttttttggaattttcagcctttttgtgctggtttttcttcatctttgtggatttatctacctttggtctttgatgttgttgaccttcggatggagttttcatttggacatcctttttgttgatgttgatgctattcctttctgtttgttagttttccttctaatagtcaggcttctctgctgcaggtctgctggagtttcctggaagtccaatccagaccttgtttgccttggtatcaccagtggaggctgcagaacagcaaagattgctacctgttccttcctctggaagcttcgtcccagaggggcaccctccagatgccagtcggaggtctcctttaagaggtgtcaacccctgctgggaggtgtctcctagcaggaggcacaggggtcagggacacacttgaggaggcaatctgtcctttagcagagctcgagcactgtgctgggaggtctgctgctctctttagagctggcaggaggaacgtttaagtctgctgaagctgtgcccacagccaccccttcccccatgttctgtgtcccaggaagatgggagttttatctataagcctgtgactggggctgctgcctttctttcatagatgccttacccagagaggaggaatctagagaggtagtctggctacaaaatcattgctgagctgtggtggactccgcccagttacaacttcctggcagctttgtttacactgtgaggggaaaaccgcctacacaagcctcagtaatgggggacgcccctccccccaccaagctccagcgtcccagatcgacttcagactgctgtgctggcagcgagaatttcaagccatcggtcttagcttgctggggggatccactgagctagaccacttggctccctggcttccacctcctttccaggggagtgagcagttctgtctcactggtgttccaggcgccactggggtatgaaaaaaaaaaaaaactgcagctagcttggtgtctgcccaaacagctgcccagttttgtgcttgaaacctagggccctggtggtgtaggcacttgagggaatctcctggtctgagggttgcaaagaccatgggaaaagcatagtatctgggccagagtacactgttcctcacagcacggtccctcacggcttcccttggctaggggagggagttccctgaccccttgtgcttcccgggtgaggcgatgccccaccctgcttcagctcgccctccgtgggctgcacctactgtctaagcagtcccaatgagatgagccggatacctcagttggaaatgcagaaatcaccctccttttgcattgatctcgctgggagctgcagaccagagctgttcctattcggccatcttgccagccacccccagaaaaagatcttttgtgccaggaattgagaataaataccaagaacagctaagaaatgttttaaataatttcctttcagagtaggaacatcattttagcatttattccctcagggagaaaattcttcaataaatatagtaatctttgggaaattaggagtttaataagaggcttctatattgactttcatacatttacttctgcagtgtttgctgtcttgaactgtaaagttaaaattaaacaatttaacttagactgaaaagaatcccatatattatcaataatgcttttcttagaggcctcataatgccaaagaaacatttttcaatcaattgaaatagtggtcccataatttcatttaaatatcagagataagactgaagagtctttggaaagccatcatgtctccccactgtcttgggttaagactgcacctagactgccctcgacagatagaaatttcaaaaatttacaaaaagattgtataacctgatttgggataacatctcccttgtcagtgtgcacttccttatataacagtcctatttggttacatcagatgaaatgggggcagtttaactccacgacagggctgcgaaagtgcaaatagagggaagagttgcatcaagaagactatggaactaactagtggttcctgggacagaggacagccgaggcagaggctctgcagaccttaagaccttctccatttgctgtgctcctgtttctccggggcattcttatccttgatacctaaagctttttgagctgaaataaaacagtgaatatatttcttcccttttaccttcacaaaaatctttgaatgagtaagaattatgaacacatatgaatttcccagtgaaaagacaaattatgtatttggttgagatataattaatacggagtcaaacatataaatcttaagtatataggtcaacaagttttgtaaaatgtgtgcaattgagtaaccaacacaaaaatcgagatgtagaatatttttaccacctcagaaagttcctttctccccatttctggtcaaattccctacccagaggcaattactgttctgatttctgtcaccgtagattagttttgtctgttcttaaataagaattttaaatctttttgaaaagtcagttttaaaaaatattaaagaagtatagttttttctttttttaatctttttttttttttttttttttttttttttttttttttttttttttttttacagagtattgctctgtcacccaggctggagtgcagtgacacaatctcggctcactgcaacctctgcctcccaggttcaagggatcctcctgcctcagcctcctgagtagctgggattactggcacctgccaccggacctggctaaacttttttgcatttttagtagagacagccaggctggtctcaaactcctggcctcaagtgatcgacccactgtggcctcccaaggtgctgagattacaggtgtgagccaccccgcctggccagaagtatagtttagtgtattaatgtttaatatgaaaaacttcctcaaacttgtttgtctctattctttttttttttttttttttttttttttgagatggagtctcactctgtcgcccgggctggagtgcagtggcgcgatctctgctcactgcaagctccacctactgggttcacaccattctcctgcctcagcctcccgagtagctgggactacaggtgcctgccaccacgcccggctaatttttttgtatttttagtagagacggggtttcaccgtgttagtcaggatggtctcgatctcctgacctcgtgatccacctgcctcagcctcccaaagtgctgggattacaggcgtgagccaccgcgcccggccagttcttaaggttaaaactggttatagatgtgtatgtatctatgtcatagttgaaattaaaaacaaaatcacagaataatctgtagaaaaatatatcttttttgttttcttttctttttttttttttttttcgaaatggagtctcactctgttgaccaggctgtagcgcagtggtgtgaacatggctcactgcagccttgacctcctggggtcaagcaattctcccatctcagcctcccaagtagctgggactacaggcgtgtgacaccacatctgcctaatttttttttttttttaagagttgtgtttttgccatgttgcccaggctggtcttgaactcctgaactcaagcagtcttcccgccttggcctcccaaaatgctgggattacaggcatcagccaccatgcctgaccaaaaatatatctttatatatttgtcacttgattgtgtatatcttagaagtgattatgcaaaccctgcaactattattgacattttctccatttgcaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaaggtgagcagtggatataaccactttgaatttgcttgtgggtcaagagactagtcactgtttggaatgttgtgtgttatgactatatgatgatagtaaccatgcactagtgcaggtatttagaaacctttcattttgtgccctctattaatacacatctgtgaaagtaatacagagaatatgatcaattagagttggaacattgaagttaaggcaagtaaaggaaaaaagtcaaatgtaagaaaaagcacctattcatcattgagttcacatccagttttatgaaactaaatgactccttagtaaaagaattgcttgtggctttggacagggcactgcagactactgaagagagcccatggtttggtctgggttgtgaatacaaacacacacttatacacgtgcacctacatgtgcatgtacacatgcactcacaaacatacacatgcaagtttacaaaccaaagtgccttttctgaatgtagcaactagtcaccaactagccactagctagtggcagtgatgacttttgcattttatttaacattaaaaagagttgtcagattgatttctacaaatatttatggccatttgagagctcatgtaatttgggtgcagcagaaacagcccagacctggattagagttgtgagtctgccccttaatagctgtgttaccttgggcaaatcacttaacctctttgagcttatttccccatctttaaaatgtcataacatagtaaaaaaaaaaaaccaaaaaaacaccatctaaggacctgtaaacacctataaggacacttaagaacataaaggctttttcaaaagctctatgttatattttctttcttatttggataaagtgtcttcttagtgcacatgaaaaggttaccataatgctaatttccgaggcaaataactgctggccattcagtcctcaccgggaggctttcccagattctctgagcccactgctggaagccctactgcgtttgcttggaggcaggagaggcacaatttgtcccagagggagccctgggatacccatagcaggcaaccaggaggtgtcagaaaaacctgtttttagaatgactttgaaaaataggctgaatataaaataataatgacatacctgacatttacagtgtgccaacattagttaattcattttattcattcattcaacaaatattcattgagtgccacctctatgccagccctggggttatagtaagaaagggaatggattaaatcctaccacatcttgttttgattttgtcttccagaattgcccacctagagtctatcaaccaggccagataacagatcgagcagttctcaattcatatggtgactttataaagaaccaagcggatggctacctgttcgatagatataagggaaggaacctcatattttattacctgtttctagtgtgacttctttggaacctgaacagtggggcgagttacgtactcttctcttgtgagattgtgaatgaaatcgatgaatacataaatgtatgcattgtactgctatttatcagtaataaacatgctgaaatgtctatataaatatatgcaatgcattgcagtttgtaagtataatactacagtgctaaaataatactttagaatattaacatcaactggttgcttttttatttgatttttaaaatttagttattaaagattgaagttttatttttaatttcctttttttctctgggaaggggttcctggttctttggagggtccatggtgccaatgctatgttcctttgtcttttttagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattggtaagtgatacatatgtcaattaaaaatatttttaaaattaaattgtttgttccctaattaagattttactttggagtttcaaatgctaggctcataatagctaccacttattgtgcatttgctatcttccagccgtttgttgtcttatatattcctaacaattctctatggataggctcattatccccattttagaggtgaaaaaaaccgaggcttaaagggggctcatttgtccaaggttatacagtgagcaaagagtgagccaagatttgaacttgtctgcctgatgctgggggggtaaatgttttggtttagcaatcgaaatggaaatctgaatgcttttcttttcacttacttcttcttaccacaatggatatacctaattgagttattgagggaattctcttctgctagtttgctctacctttcctggtgaggctcagccaggttttaagcttctctcttctcagatattaactccattccagtaaggttagttcagttcagaatgaaaatgagtgattgattaagcacctactatatgtaggtcactgtagtagacttaggagatagagttgtgtaagaggtttctaggctggaaggggaactgagacctgcagcgagtgacaccgtgttatgagtgtcttggaagctggcggaggatgtgacgtgaaacctaaagcataaaccctcatttgttaaactcccctctacctgaggctccaggtacctgctgctgctaggaattgatgggacttgctgacctcccagtttggtactggagttgggatagtgggtacttagtcctgtacttctttctgaaccttggagtattcatatgaacacacttccccgaggggcaagatggaagccaagtgcaaccgcagcttcttgaaagacaaggtgctttgtcactagaatgagatgaagccatgttatgtgtcttgttgtccgcattgtgtagtattcctggccttctgggaatctttatattgtgagagaaggcacatcaagtacacaagggggttagagtgaaaaaggcttacagttttactcttaggttcattaggggaatttgttgcactgcatctgcatgccagattagtcaaaatgtatgggccctactggggccaaattggtggcctctttttattttctaaaattagtccccttcagtggacacagttgggcatatttgccttggggactgtggacaagaagcagccaggaatgtgcaggtggcagctgctatagagaagctgctggtggcccctagactgtgggaaaagaatttggcctttaataaatgtagatgcctgtttggaatccgtctttagtgtagaatgaaaatttaaatgtatatatcaagatgagtcaccaaaaaccgtaacttacacctgatgattaccttaatataaaggatgtggtgttccaaagcattatatgattccttaaacataaagtctaacttttggttgatgtttgtctgtcagcttggtgagaatatgaaagttgcatttgggaaaatgaatgtcctactggtgggacttagtatgttgttagggtcttaacggcttctctagaaaattttttgaggcagtgtgaattccctggtgtgctccaaatcgagccatcctgggtaaatgtatcagcttcaaatgtcctatggtccatttcagtcgagtccttgtgctaatttctttctgttcacttcttttgttcactccgtggactaattgtattatgtaaaaaaaaagtagtctgtgcctctaaagctaatataacatgagcattatgcatttaaacagaaaattatgcaaatgcaaaattatgatgcatttcatagtcacactgactttttatatttctcataacatatgttaaaatatcccatttaacagacactattattacacaacatttcttgtgttacaacagtgtacttaatgtaagtaaagactagaaattatatctatgatgaggtggaggggagaatgaatcagtgttctctgataatctttgcatttgcttttcctgattttttggtaaggttaaattaatatccttaatgttgcttagatacagttatttctgccattttaattttatttatagttcatctggtctcagcaattttttaaattgaccaaattacatgcgttatgttttggtatccttaaaacccaaaccaggacaaagtcccatcaatcattgtggttctgtcaataattgtggtcacatttcctcctttgtcaataattgtgttcagtagaaaacctgggtatctccactgtgcagcacgcaggaaggatctgacaagcagcagcaacacagctaggggcgtctctagcaggaagtcacgggagatttctaacgcagtacgccgccttggtgctttagtaccttctcctgtgtaatgacaccccaacatattttgggggagaaaaaatggcagacaaagagaaggagttggccacagtcccaagaaaggtacatggataacctttctatttatgtagaagtggagggcttgctaaaattccaagagacatttgagctcctgtgtaaaactcaatctcttaagatgattccttcatacatttaaggattctaaggagaaggtgattccatagatttcttctctttaatagtgcagtgggaccccctccatcagacagtttggccatcctgctggccctggcttgcctgccaggctgtagcatgtcactccctcattattttatgtgaatgaacacggtccggcagatggaggtctgttgatctttcctatagcatgaaggttgaaaaaggctctaggggttccagcaggtgtttctttcactaaaaggacagggatcaaatgtaaactgttcttacgtaggaatttctgctttaggttattatttgtctatcagtggactttcttattttttcttagtggctgggacaatgaaactagtaacaagattgttcattcttgttgctgttgaacacttattgggctatgcttagattcaacaaaaatcttaaagcacctttaattttgtggagtcatttctggccatctctgaatttttaggaacagcaggacatttaagatgagtgtttaatgattatttgagtgaattggacacttaaaattgcaccaataggatagaattggcttctggtctcatcacatggccctgatggacctaacaattttgtttcttttgcttcccctatgaaatgaagatggttgagatgggaggattcttaaagattttatagctctaacataatgtgattcacgaatttaggtttcattgaaatcatttgacatgggtattgaatacaagcacaagtggatttaccttgaagctaatgaagcgtaatctttagaggtcttcctttccaggggtcccaatccaaggccctggcctaactttgtcttagtaatttgacattctttgcctagaagagctttgcccaaattatttaagcttccagcctcccaaaacctgtattcatctctaggctactagaacataagcagtgaacgttgaggtaactgaaggcttttcccagtagtctttcccactgagatggtgaatagaaaatcaccacgaagaagcattaagactcctttgtaatatgtatcatctgtctgccaatttgttggaatctagtcaaccatggatgggcattcaatatatatatgttttgacaagtcacttggaattagaggaatcagataattaaaagacatatctgtctcaggatctagcagaatgccaacttgagacattggggaagatgctttgtacaaaaatgtatactttttcatttattcaatgaatatttttgaacacctaaaacacgcaggatgctgggatgatggaaaaccaaagtgaggaaacttgtcattcagctgtgagtccagagctttgtgaacgtatgcaaattacccagataaatgggatttaaagttggatcttgagccagagtttccaaaaagatgtatgtggtggtataaaagtcaggcatgatggagtggaaaagttctcagcttttatacactagatggcactgtgggtgcagaggaaagctctaaattggttcttttgttacttaaatctgttgcaaaaattatatggttgagaaaacaacagtgtggtataagccctgtaattctagggggaagtgtagaatgcagtcctaattactttgagattcaatatgtgtcctcttttggttagactgcttagattggtatgtagagttgtatgtatatgtctcctgttgaaagaaactcctcaggcccagatttttaaataatcacatacagctctcctgccatggctatgatgttcttcctgaaatgaaagaccaaacagtggtgtgttagatgtaatggttagcaatgatagagtctactgcaattctgcccaattccaagatttgaactctcctctttatttccaagacttttctttaaaatcaccataaaaatagcaatagttgaagctcacaagtcacttctgtactggcacactggctcccccctttcactgagtcacctttataaacatgtctgctgtaagcagtctctgttaggatgtaacaatactcttttggggattgtttttggggaaatttcacacaaaggctgctaggaagtctaaggacatatgaaagctgaaaatgttttcaacaagagttagaagtggcctcaagcccttagccttttgatcatcagttaaaaaacaaaacaaaacaaaacaaaacaaaaaccaaacaaccaccttaatattaagagttaggttatcttggatgaaaaattgatctccattttctcttccggaggtgtgcactaaaatttgtactcttcctctatgggaactttgacagtggaaaaggaaatatttgcttatgtagaactcctttcatacaggattgaaaacacctatgtcatactgaagcttggggaagaagtagaaaatagattctgtgggagtttgttttgttttgttttaggaaagatgtggcatctttttttgccatttatgttggggacaaacacagtgacttggatagaccaggtcaatatgttccttgctctggagagcacggttgcttctgagattgtacagcctcgcaaatgagtacctgaaagctcctaggctattacaaatatgttaccagctctctctccacctctctttcctcacagatgataagtatataaataaaatcaacagtatttaccgcgtagcactcccttggagagagtaggcagttggctattttaaaagttttttctttttctgttttgtttgttcgcttcattgcatttgagtgcaattgtagtcttttcttgggcttaacaaaagctacctggggccgtggctggtgagaggaaagttctgttttggtgtttgtttttgaactacatagggaagtactatgacctggagttactttggaggcaatggagggtactcaaatacagggtgcagtaggaggagatggtggatggggaaggataaaggtgaatagtcaggagtaagtcctgtttggaaaagaattttattagtgagtgttgactgagataggagagggctaaattacaggttaaaatgtggaacgagtggcctaaagtttcaagtttgaattttcatattattggaaaaatcagaggagaacaaaaaatattcagaaatgggaatgtgatgacaaaatataaacgtttacttatttgacatagattcttttttttttttttaacttttgaaccaatggtgattattaagtgagttccatggtttttgtaaacatgattgaaaagtactctcacaggattttgctgttttgtttgaaagagtttaaaatagtctacaaagatctccatgttcatcttgaaaacataacaaacctttcaaaacagccataatcagggcaaaaaaaatattgatgttttgtttgcctttgttttgttctagagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacaggtgcttgagggaaccatgattttagtctgatctttcccaaatgtgtttggggtttataacatagttctcatgacgaaacagatgtcacgcagctcatctaattgcaagtccagggagacattattataggcttttaatgaggttgattaacatgcacgtattaacaggttcttacctgagtgcttattttaataagtatcatctggaggcccctaaagtaatattatctctagtctatgttgcctttccatatctatctatatatctgtctcccgaaaataggaaagatgtagagtaggagttaacaagctctttcttaaagggtcagataggaaatatttttggccttgtgggccatacggtgtctgtcacaaccactcagatctgcctttgtagcgtgaaagcaccacagacagaatgtaaatgattgtgtgactgtgttccaataagactttttttatggacactgacattcaagtttcatgtaatttttacatatcacaaaatattactcttattttgatcttgccaaccgtttcaaaatgtaaaaaccattcttatctcaaaagtcatataaaaacaggtggcctggtagatttggctcactgactgtggtttgccaacccctgctatagagatttcaaggatttatacgtgtttttaaaagtgttatttggtgattaatgttgttttcacttgagaggttggttgagttcagtaaccataggtttctcacttggctgaatataattttaaatgatggactttcagaagtattcctaatagacatggagaaaaacctgcctgtaaatcatgcatatagaatgtagacactgccctcggctactttttgcttctgcagggagagcaggccctggagaaagaagtcaggggaaaagtggtggggaaacattgtaggtgcttgaataggatgtgggctaagggttacagtcctgtgtgagggaaataatggataaggagattctggggagaagcagtgataaagggaatgtggtaagtctaggagaaggagaagaaaaagacatcctgaatttcataaaattgattggggtcaggtgctgttgtagcacatttgaaggagagagaacagtagttatgttgtatctataaaagtggtaaaaattgattaagaattatatagaatgtcttaaagtctgcctttgctatgacatgatgtcctttgtctttctagaaataatcttttacttttaaggattttagggttctatttttaagttttagatttgatgcttctcaggagtggtccctgtactttttagaaatgctaattattgtgtctcccccacccccagactgactgagatagaagctctggggaaggggcccaacattctgaattttctcaagtcttccagtggattctgagacacaccagtgtttgagaaccactgatttttatcacataagagggttgccagcttatactctgtcctcccttatcgagaacagtgtttaggtgaggttccagggtaggacttttgatggctaactgctgtttttaaggacagccacccgaaggaggcgggcaggaagaatgtccctattgtaaaaggagagggaatttttcttataagtaaacaagatgaaatattatccagggtgttgtttctggaacccaggggaaaaccgttctttgtgagtagttgacttagtccctctttctgtctacactgggtaaacttgcccacagaacactgactgtagatggtattccatgttcttttcatgttgtcctggctggagaatggtagtataggcacaaatgtctctcattttgttctttctgtccactgctcaatctgtgccaggaatacactttcctcaagctcttctcacacagggaccatgtttccatagtaactagcacattcggctggagacttatagatgagtttgaataacccaaggttttaaaactgtaagaacctaaggaagatgatttcacaaagcatacaaagaatagttttttaaaatacaaataaactgtgaattgagacatggaattgtacatgacacattgattatatatatattgctattaaaaatgtacttggtgctattattatgaggttaatgctgatctatgagtcattggagggaatagtttcagattaaagcatatgagcttttgatggatataaagatcttctttattatctgggtagatatcactgcggtagcctgctgggcagattgtctagtctgaggagggagaaccaggataatatctttcttgctgcaccaggctgaattagttactctgttctttgtgtgcccacagtactctgttgattatatttctaataataatattactactattactgattactcataataagccattagtggttactatgtgctatgttacaatacttaatctaatttaatcatcaaatccttggaaagtagataatgttattgtacccattttttacatgagaaaactgaggctcagagaggccatacaacttcctcaaggtgacacagctaatttttagctgaactaggaactgaacccagggaaatctgacttctggaatttacctgtctttcgacagaacctatacatataacagtgcatcttaatgacttgtttatgtaatttgtgggctccttttagaccaagagctccttgagggcaggggccagctttattgcttccataagagttagtgctggctatatatttggggatcaatagtttgtctaagaagagaaggaatggatgaagaagtgagcaaatagaataaatgttcactcatccagttcttaatcatggatagaagagacagatgacttctcaccaggagggttattataccagacttgtgccagtcataaccatatagcatccaaaaattcatggtttaatcttcatctctgtcttgttacagatattgtccatctgctgtccccaccagtcattttttttcttcttttaaaaatgtttccccattaataaaaataagccttcatgtgtgttccaaccataagactctatagctctagatatatttgaggtttttagtaggtgtatagccctggatgagccattcattatcttagtgaataactagttcttgaatccctgctgtgtgccaagcagtgttctgggtgtttgtgatacatcagtgaacaaaatagacaccaaggcctgccatcgtggaacttatattctagttctgggaggtggaccatcaattaatacataagtaaattatgaagtatttacaagatgttaagtactgtgaaaaaaataaagaaggtattaagttgctgtggaaagaataaaggcagattgggagtatggggctgaggaacattcctggttgcaattttaaatagtgtggtcttgatggactttactgaggagaggaaatgtgctccaggcaaaaggaacagtcggtgtaaaggccctgagcaagaagtgtgcttgggatgtgcaaggagcatccgggaggccgacatggatggagtagatgagtaaagagcagagcacacagagaggagatgagagtgtatgggggactgggtacacagggctctacagactgtttaaggatgcttttgactttgagtgataagggggccattagaaaatttgagcagagaagtgacttgagctgattttcttcttaaaagaatcattccagtgtagtgttgagggcagactatagatggcagtggtggaaattaagactgggtaagaagctactgcagtagtccaagagaaaagttttggtggctcagatctgggtgagcgcagtggaagtgatgaaattaattagtggatcctggaattattttgagggtagggccagtgggattccctgacaaactggatatgaagtatgaaagaagtgaggagttaagatgactctcaagatttgggcttgagcaactggaagggtggagttgccatctactgagatgagaaagactggagatagggtaggtttagggacaagagtagaagttcagttttagaaccagttaagtttgggatgtctattagatatcaagtggcaataccaagtaggcagttggatacatgtgtgagtatagggttcagaagataggtgaatgtggatgccatcagcatgtagatggtatttaaagccatgataccaaattgtattaaagccttgagattggatgaaatcaccaagggagtgaatatacctagagcagagcatgaccaaggaataaactctggaacatccccaattaggagcttggggaaaaaaggaggaaccaacaaaggagactaaaaaggagcaaacaaggaggtaggagcacaaccaagagaatgctggatcccggaagccagtgaagcaagagtaacactgaaggagtgatcatttgtgccaattgctgctgattggttaagttagataggcacaaaaaattaagcattggaattggcaccgtggagatcattgttgacctctacaagagcagtttaggtagagcaaacctaatggaaatggattcaagagaaaatgggagaagaatttgaggtaatgattttagataactctgggctgtatgtagaaaaagttaagacatggcttcttgacctaggaacttataatttgtttggggacaacgggaataaacacatttttaaaacaaccatccaagagtaaaagtctatatagagctaaattgggtgtggccttacaattgatgcaggaggtataagtaggtggtcagctggagcattgtgataaaaaagaatattctgggaagtttgaaaagtagttattagggaaatatctgaaaacatttgcagtgcttctcaaagtatgcccaggggaccaccttatcagaatcttctggggtgcttattaataatgcaggtttctggagatgtgagctaactactgaatccccccatatctctggggattggactctggattctatatatttaacaagctccccaggtgacttttatatataataaactttgtgaactgctattctaaaagttttattgagtagattatattctcaattgatgagatctccagaacactagatttaggtgaaaaaaaaaaggcatattgaacgtgtgaaaaacccacacttaacatgtacacttataaattataagaagttaaatttacagtaatattccttttcctgaagttagaccttcctcagttgtttcagtgatatttctagtatctgaaatgttatggctttcttgtgtgagaggggctaccaaatctatttgttacatataaatccaattatataccagagaagatggttgacaaggcatagcttccccccacactatatgaggtctgtctgaagcctggaaactgggtacagagaaaacagccatgcagacctggctgctttgctcaggctgttctggggtgagccttccaaactgctgcacaccgtctcacatggggcctcaagcctaggaatcttggtgctatcctttttcagcccggattcttgtacagcctgagaaaggagcagagaaaagcactttttgcctctgcaaatcagaaatacttggtttattttttaaatcactgtgaacacaaggaaagaatgattttcagtataggagaccctgcaagggaagacttctctgcttagagttgtgacagaggacatggtttattctcctgtgtacctccctggggtaatgattttagttatcaaagacctctccaagggtttactgtttcttacaaagtccacctttcactagcggatatccacagacatgcttctgctacagaccataaatcaatttcttcagtgaccaggcaatcagctttggtaacttttaattctataatttgatcctatctttagtctactagactattctatttatgcatagaattctgagtgcaaattccaatcaatacagatctcataacaattttccataaacatttattgaatacttacaatgtaaaaagtattatattagataatggttaataagacaatctttgtccttggaaaacagacttgtaatggcttacaatacgagtgataagcactatttaaaaaaaaaaaaaggtgggtctatcatatttgttatagcatttgaaaaggaaaagttaatttttcccttgaaggaagttggggggttgctggggagctggaggagtgagtctgagaggggaggatgtgggctggaagacagaaaagtaaagggcatgagacagtgagtggtgaatgggggaggtagccccagatactggcagagcccaggattgcccaggcagtagggctaggtgcttgctcttctttccagcatgattattgtgattggtgactagccttgtcattagagaacagcctgttagtgcagctggtttgaacagtgtgtttatgacgtttgttttgggttcattttcccaatgtgttacccaggacatgtaaagaatcagagatatcttaatatactgagaaaattcctctgcatttagatttagaaccttaattagacgatggttgaactctttcactttggacagtttatgcctactatattaaagccatattatatcttttgcagacttttaaaaacataatatgtggaagattacctgtataatgctctaactctcatttctcttccatttagctatggctccaaaagcaatatactccgtttttttgcaaaactagtcacagacaaatgtgttg

SEQ ID NO: 3361 - DNA, 194953 bp, human
aaacaacacggccgggaggcgccgctgcctgccgggccctctcttctgggaccctggattttcggacactgagcgccatggccctgcctctgctgccgggcaacagcttcaaccgcaacgtgagtaggaagggcgtccgaggtcacagctcccggctggagtctggggtccaggcagggtcgtggcgtggccacctccgcagactctcctggaggccccatgctgctgccctgggttggtggcaacttggaccaaactttataggctgcttctcccatctctccagctgcatctgaatgtttttcctaatttagaaatatatagagagagtccttataggtggcaggaccctcaaaggtaacaaataatagtgacgataaccattgggggtttaatgtgtgccaggcgctgtgctttaatcaccttatgcagcatccagtgtcccaacagccctttgaattaggtagtttttattcccagttactattgaggaaactgaggcacagaaccacacagtctcagtggtgaagctgggtttctttcaagcaaccttgtctccacagctcaggagcctaatcattatccccagtatcctgtgtgaaaaaagataccgtttcaattatcaaattgaagaaatctggcacttatcaagaggggtaggtggcagataagagttctatcagcctgtaaagtttactcccaaactttatagagacaggcacccaaacttggagggattttttttttctctatttataattgggaggggttcatttctttttttttttttgagacggagtctcgctctgtcgcccaggctggagtgcagtgacccgatctcggctcactgcaacctccacctcccaggttcaagcgattctcctgcctcagcctcccgagtagctgggattacaggcgcccgccaccacaccggctaatttttgtatttttagtaaagatggggtttcaccatgttggccaggctggcctcggactcctgacctcaagtgatctgcccgcctcggtctcccaaagtgctgggattacaggctgagccactgcgcctgtcctggaggggttcatttcaaaagaagatgaacgtacagaacaaagcaacacaacacaaaaaaccctgagcatgaaagaacttttgccaataaatagcacctcatttaaacgacagcaggaaaatgattcaggcttttgtttatactggttactacccttcacttgggtcagccatctgtgtctgcaggagaagctaattcccaattagatgggagggaattagatggagccactcaaggcaattgtgtaaacctttgataactttagaaagcaggcagcagattgaagtatttggctttatggtttccaaacactgtctgtatctaagttgttggccctgaagtacaagttttttctttgtagcttcacgccattgaattctgacccctacacgtctggtcagtccaactttgaacactgatttgtgcatttcttggttgatgggcagaggctggccttccagcatagcattgccctttggtaagtttaagccagtcacgcaaacaagaaaggcccctgagagacgggacatgaaaacagattccagaagtaaagaagcatgctgtgtaaaagtaattttaataaaaaatgaaagtaaagcctacagctttttgcccagcaacactctgattaccagtgcctgcctcctgcagaagtatcatagctctcacgtgcagtgattaaggatgggaaggaaaaacagtggatggatgaaatattaataaatctgcaaggttctgcgtatatttttgctttttaaaaaactttaagatcatgaagtacaacacatatacagaaagatgcacaatggatgatcacaaaatgaatatcaagaaattaaatatgggggctgggcgcagtggctcacgcctgtaatcccagcactttgggaagcagagatgggaggatcccttgagcccaggagttcgagaccagcctgggcaatatagtaagacctcatctctacaaaagattgaaaaaattagccaagcgtggtggcacatgcctgtagtcccagctactcaggaggctgaggtgggagaatcatttgagcctgggaggtcgaggctgcagtgagccatgattgcattactgcactccagcctgggcaacagagccagaccctgtctcaaaaaaataaataaaataaaatatgacctgttctccaaaaataccacccttgactggggttgccagatttagcgaataaaaatacatatctcaaatactgcatggaacctgtttatgggaaaggattatttattgtttaccaaatttaactgagaatcttgtattttatgtgacaactctacctatgaacctttctgttcattaccccatctctactctccagatataaccactgttctggctcctatcactataattaggttttgcttgcctttgaaccttttatcaatggaaatgtttggtgtttattcttttgtgactggcttttttagctcaacagtatgttcgttagatttgtccatgtggctgtctatagaggtagtttgtacatttttattactctgtagtattgcattgtatgtttttcacatcatttatatatacattttactcttgataaatatttggcttgtttggggttgttaagaatagttttactgtgactatttttgttcatgttttttggtaggattgctagatcatacagtattcgtatgttcagctgtagtagatgctgtcaaagtgattatactacttaaattcccaacagcattttatgttcctgttgctccacattctttctaacacttggtattgttagtcttttaaattttagatattttggttggtgggtatagcaactctttgtagttataatctgtacttcctgattcctaatgaaattgagcatgttttacacgtttgttggtcatttgtatgaccatttattggtcactgcttttttttttagacggagtcttgctctgttgcccaggctggagtgcagtggtgcaatctcggctcactgcaacctccgccttctggcttcaagcgattctcctgcctcagcctcccgagtagctggaattacaggcatgcgccatcatgcctggctaatttttttttttttaatttttagtagagacggggtttcaccatgttggccaggctggtcttgaactcctgacttcaggcgatccgcccgcctcagcctcccaaagtgctgggattacaggcgtgagccaccgtgcctggctttatttgtatgaccatttattggtcactacttttttgtgtagtacttacttatctcttgtctaatgtttactgggttgtctgcctatttcttagtgatttgtagaagttctatataaattttgggtatcttcttgtctgtgattggccttttccttctcttaatgatgtttttgatgaataatttttggaaaagatcactctttctccatgtctctgcagagccactttgtcaaaaatcaagcatccagctacgtgtgggtctatttctagactcatgaatatttaaaacatttatttactttatgcctgagaacaatgggagtgtgtgcgtgcatgtgtgtatgtgcgtgtgtactagagaatgacagtaccttggactcattcaacaaatcagtatttatttattgagtatcctagtatatgccaaaattaggtgactacatttaaaaaattgttacactagccttggtactaaatgtactgtgtgttgcccacaaattaatattttaaaaacttgtacttagttaaaagattggatgttctctggcatagaatggttagaaagtcagtaaagccatatctggccttttagtcttgcccttcccccctcccctgcttgctgaattaaattaccaagtgaaaaaccttggcctcctgtagatagcataattacttggctgtttggatttaaaattataacacagctaacttttattgcttttccatagaattgaaaaggaacttatgtgccccttacttagctgccagtggtcagtcaaaagcaatagattgatttctgtccacggctaggtgatacgcaacctgtatttctctctctcaaatacaagaagtatggtgccttctaaaatatgaacatttgtacctctgatgacattacaattattttgatatgagttgaaaaccttagggaaatatcacaactaaattctagatacactgtatcttttttccaacaatttccatgctgaacttgtattgagcaagagaatcttgggcatattatcaaaattgaaaatattaaaattaaaagggacatttccagccaaagccaaaaatcctttctgcagtattttggacagatggttgtgtggcccatcctgatcctgagtgtctctaatgaatgatgaagagctcactctttctgctttttttttttggagatggagtctcgctctgtcacccaggctggagcgcaatggcgccatctcggctcactgcaacctctgcctcccaggttcaatcgattctcctgcctcagcctcctgagtagctgggattacaggtgtgtgccaccacgcctggctaatttttgtattttgagtagaattggggttttaccatgttgatcaggctggtctcgaactcctgacctcagttgatccacccgcctcagcctcccaaagtgctgggattacaggcgtgagccaccgcgcctggccgctctttctgcttttaatgaagctaccttgccaccatcttaggagggtttgctgtaaatagcccatcatctaatttgtagtgaagcaaagtcctccttaagaaaaaagaaaacatatttgaatttgcagcaataaaaaaaaaaggaatttaatgaatcatgaccagctttttttttttttgaaaaggaaaaaagaaaaagaagagagtggggtagaatgaagaattagagtgtattatgcttgagaggagttaagtgttgcacggacctttttgtccttcctgtgtgtgcttgtgtatgtatgtgaactggcctgcactaaaatatgcctattactgtggttgtgcaatcagtgtttgaaaaacactcattcgagccatctccatctttttttttttgcgatagggtcttgctctttctcccaggctggggtgcagtggcaggatcacagctcacagttcactgcacgcagcctcaacctctcgggctcaagacatcctcccacctctgttgccacagtagctaggactacagacatgcaccaccatacccagctaattttttaaattattatttgtagagatgcggtctcactgtattgtccagactgggcaattcttatttaaatttagatcttcagcttctttcaaggtcagatctcatctctcacccttcaaagagccttgtcagcctttcttaatgtatatttttaaattttttgaggtaaatttcatgtaacatgaaattaaccactaactatttaaaagtatacaattcagtggtacttggtacattcacactgttgtgcaacaactaacacctctaactagtttcagaacattttcatcacctcaaatctcaatcttttcaccctggaggagtctttgaaatgattttgaggtcttagagaactcctgcataaaaactatatctatagcccatggtacattagcacaatctgtgataataaatatgtaattacataaaaagatgttcaacattatagctattagggaaataagaattaaaatcaagatgagataccactgtatacctattaaaatggctaaaatccaaaacacaataccaattgctcacatggatttgaaataacaggaattctcactcattgctggtgggaatgcgaaatggtaatttcttataaagttaaacacacacctgccatatggccagttccgaatttatgtgaaataaataaattcccataaataattctgggttaaactcaaaataagcacatatcaatttcattttcaactggaatgagaatattgtagctataataatccaataataattgtctttttaaagtaaaaaatggtagttttctgtggatctcttgatttcagccaacttatttacctactctttccctttctcacaaagggttatcaaccctaaagcaagtgggaatgtagaagaggaaacttcaggttgttttatggtaaaattttctacttgatttatttttcctttttaccttatccaagtaggcctaaaagttctctatagtttctattatagagggtgctattgaggaatgatatatggtatatggtatgaacaaaagtagttttctcccctattaaaaactgaaaaggactttttaccagcttttttgagggaaaaaaaacccaaaacagatagttaaacttagcttacctttctttcctttccatacattcaaaaaacttttcagtcagcataatataaacatgttaaataattcaagttatttctgtttatatctaagatggaatttactttttcaaaaagtaggctaagatgatttaatttaaataaaggttgtaaactcgtaattaatgctgttttcaacatcaaaatgtattgacaatgttacataataaagctactaaaactatatgacaaagcattatgagtaaaaatataacctaagatataattttatacaagacttaaaaattaggttcttttactgactgacatgattgggcttaaatataggcagttacaaaattataatcttgatttctttatagacctgtatgtacataacagtcttattttttaaaagctaaaaataaataataaaatttacctctccactctgaaatctgtgtttatattttgccacataaataattccgggtcaagcttgaaataagcacacatcaatttcattttcaactggaatgagaagatttctggccttttcaatacttgttaaacaaggaaagctttgcttacatgtataagaagttgaaaattatagcaaaatggtcattgctctcctatgaatggcaggatgcttacttttatgtaaattttgaactggccatatggtaggtgtgtgtttatcttgataagaaattaccattttgcattcccaccagcaatgattgagaatttctgttattccaaatccttgtaagcaattggtattgccagtgttttggattttagccattttaataggtgtatagtggtatctcctcttttctctctctctcttttttttttttgagactgagtctcactctgtcgcccaggggagtgtagtggcgcgatcttggctcactgcaaccctctgcctcccagttcaagctattcttctgcctcagcctcccgagtagctgagattacaggtgtgtgccaccacgcccggctaatttttgtattttgggtagagacggggtttcaccatgttggccaggctggtcttgaactcctgacctcaggtgatccacccacctcggcctcccaaagtgctgagattacaggcctgagccaccacacccggcctggtatctcctcttgattttaatttttatttccctaatggctatgatgttgaacatctttttatgtgcttatttgccatccgtatatcccctttggtgaaatgtctgttcgtgtcttctactcatatttaattggggagtttccttacttgaattcctgacctcaggcgatccgcctgatgagttttgaaagtcatttttaatatagtctggatacaagttgggtgcaagtctattattgaatgtatggtctgtaaatattttgttccagtctatggcttgaattttcattctcttaaagcaaggctaaaaaatatgtacatatatttaaggataaaatataacatgagttcaaaaactattgttttcaatgcaaattaaggattatagggtttttacttctttgattttatatatttacatgtaatcttgcttcataagtacattagctgaattacttatcctaacataaataaaaatatacaaccatataataatttttaattaataataacattattaacaatttgagttttgaaaatagtttaagatttctttatagctatttctgttgtgagagtatatcccaccaggaatgtatagtcaaattactgggttttagtttcatttaaatcattgctgtcggtatggttaagtcaccaactcagtatctagttaggttcatttgtttcattgtgcttttgtttctgaacttaaaaaaaggcatttgtatggtctcaaagtcaaatttgcaaagtaagttactttcagagagctctagcttttatctctgtctcttcaatcttattctctccctctctccataataacttaaagaaaaaactttatttagtttgaggttatcctctttctcttcctccttctcttctttcttttttttttaatttttaaaacagcaaattgttaaatttattcacatgttccccttttattcaatacttggtagcataatctacacagtcttttgaaccttccttttttcattttaacagtatatcttggagatcacttggtagtggtatatagggctcttcctcatttctttttatagttacatagtactccattttgtagacttacaatagtttattcaaccatccccttttggtgtacagttacattatttccagtcttttgttatccaataatgttgcaataaatagccaaactgtgcttcaaaagacactatcagaaaagtgaaaaagcagctgacagtgtgggaggaaatatttataaagcatattatctgataagggactatattcagaatatgtaaataactcccaaaactcaataataaaaagacaaataggccaggtgcggtggctcatgcctgtaatcccagcactttgggaggctgaggcaggcggatcacctgaggtcaggagtttgagaccagcctgactaacatggagaaacctgtctctactaaaaatacaaaactagccgggcgtggtggcgcatgcctgtaatcccagctactcgggaggctgagacaggagaatcacttgaacctgggaggcagaggttgtggtgagccgagatcgcaccattgcactccagcctgggcaacaagagtgcaacttcatttcaaaaagccaacaaacaaacaaaaaggcaaataatccagttttggtggtatgggattgctgggcagacaaaacaattgctgtctactatgctagatcacaggatagttttgatataaagaattctgtcactttgttcccagtaactattaaaatatccttgaaattacattatttcagattgggccgcttattgaagctgccatccatactttggaaataacatattccattgctattcctaaatgttcatttgaatttcaggaattagagtctctttgcctatgtaggattcaaacacctaattttggtcaccatgcattctgtactgaacttcgtagctctgtcacctagggtacatttgactataagtcacagaatacctgactaacagtggtttaagccaaattaattttctcataagaactttagaggtgtagcagtttcagatttaggcagtgactgatgaatgtcataaagaacccaggctctttttatctctgcattctgccatcttcagaatattggcttttctttcttaggcttgtgacctcatagttgcaaaatagttgcctcagttccagtcatcacaactacatgtaaccatgttcaagacaagcaggaaggagagggaggggaaacagctcttcttatatgagaaaacaaaatgttttccaggagccccccagtagattccctccttccatcttatttgctaaaattgatgcacatggccatcctttactacaaggaatgctgggaaattatcttgttttttttttcaccatctacttttggaggtgggaaagggaaaagagggttcaatagtggccaacaaactttgtcacaccagccacagacaatacctgtgagtctggtattgtcagacttagtagtatccctttcattacaatttgtgtttttaaattatacaagtaacacatgagtatatcaatattgcgaaggataccaagaatactgttctttgtaaactatcttcttttccataatgggaaacaagcctaatactccagttaatccagcatgttcactgtttgtcctttgggtatattttggacttttccactcaattattagtttgtttgtccccttgcctgatagcagcatcctcatgcctcttcctcttcccatctagatcctgaccttccctcaaaacttggctttaatcccccctcctcattaaagccttccccgatcatctcagcaagaaccatctgtctacataagcttgcatgctcatattgcccatttaccgccttatttcctgcgttgtgttttgtgttctttatgtgtgatcgtggcagtcctcagttgactaagaaactgtgattggtggctctttgggttgcccttcacgttctcagtgccttccttacacaaaccgggtccttaataggtgattgtccattgctgcctctacctgcagcaaccatggttgaaacatagatggaaataaacacagcttgggggaatcttctctggaattagtttcctgcttatgtcttccgctgctgctgtggaacaaaatagttcttgttttagcaatagtgaatataaaggatgaagaaagtcatttgcttttgtggcttaaataggagataagtctctcgggatacatggtttatacacagcagccagggcaatatgaagatgtccctatctaaattgtgacacaaagcctctctgtggcctcttgcaccatgctgagggatagttttctctctcttattggcatccagtttgggttttcctggaagcagcaggtttgtctatgcatattcatcagtcaggactcctaaggagaccattctcccctcagtaggattccggctatgctaatggtaaagggatttcttaggccatttcctgggggagtttattctgtttctatagttgcagaaagggcagagccaacttcttgcagaggggggattccctaaagcaaagggtattgagggatgtgcatttttatttcccccttacccaggcccctgggtgctcaaattctacctggtgactccagtgtggcaaagtgaacagcttgaccagctgaatactgaacaaattctttgctttcctaatggtatgtttgacatcccaaaggagggaatggtcaaaacaactagatttttttggggttgggggtggggggaagtttaggtcaattgcatggtttaactgtaatttagactaccttttcttcttcacatgaatttggtaattgaaacatactgttctgttaaattcaagcacagatgtttgtttaatcacttacaggactatttccatatcatttcggttagagtttagtcatttgttgctcagctgtgttcagacctaaactttataaaaggcacgtgagtagagcctctcctagtgactaaggaacgtggaccttctctttccttttttttttaaattgaagtttttattgagataattgtaaattgacatgtagattcacttaagaaagagtacagagaggtcctatttacccctcaccccatttgccccaatggtaacatttttcttttcttttctttttgtttgtaagatagggtcttgctctgtcacccaggctggagtgcagtggcatgatcatagttcactacaacctcgacctccctggattaatcgatcctcccacctcagccccttgagtagccgggaccacaggtgcacaccaccacacctggctaatttttaaaaattattttttctagagttggagggtcttgctatgttgcccaggctggtctcgaactcttggactcaagcgatttgtctgcctcggccccccgaagtgttgagattacaggtgtgagctactgtgtccagctcatttttcaaagctatagtataatatcacaatcagtatcttgacattgatatactccactgatcttattcagatttccccagcttcacttgtattcatttgtatgtttgtgtgtgtgtatttagtctaacctacacatgtggtgcaatgtatacatttccaccacagtaaaggtataaaacagtcttatcaccacagggattcctcatgttgtccttttataaccacacctcgctcccttccaccaactcccccaaccctaccattcctaacccctggcaacaacgaatctgttttccatttctaaaattttgctatttcaaaatgttacataaatggagtcataaagtatgtaccttttggaatttgttttttccacttggtataagtccctgggcatttatccaggtggttgcgtatatcaactgttcattcatttttactactgagtagtagttcatgtatgtatcacaatttctttacatttgcctttggaaggacattggggctatttctagtttttagctattatgaataaagctgctgtgaacatgtatgtacaggtttttgtgtgagcatacattttcatttctctaggataagagcccaagagtgtaattgcgtgttatttgatacttacatgtttaattttataaaaagacaatcaaactatttttgagagcaaattaccattttagattcccaacaatatatgagtgatctagtttctttgcaccctggtccgcatttagtgttatcactatttttattttagctgtctgagaggtgtgtagtgatatctcatggtgggtttaattggcatttctctgatggttaattaattgaatatcttttcatgtgcttatttgtcatctgtatatccagctaagtgaaatgtctgtttatgtctttggctcatttctaattggattgttttttactaagatttatttatttatttatttggagacagagtctcactgtgttgcccaggctagagtacagtggcatgatcttggctcactgcaatctctgcctcccaggttcaagtgactctcgtgcctcagcctcccaagtagttgggattacaggcatgagccaccgtgcccagccttgttttttttactgttaacttttgagaattctttatgcattctgaatactagtcctttgagatgtggtttgcacatatttcctcccagtatgtggcttatcttttcatcctgttaacagtatcttttgtagagccaaagtgtctcattttgttaaggtctaatttatcggtttttttcttttatgagttgtgcttttggtgtcaagtctaaggactcactgcctagccctacatcatgaagattgtctcctgtgatggtttattttgagatggagttttactttgttgcccaggctggagtgcagtggcacaatctcggctcactgcagactcaacctcccaggttcaagcagtcctcctgcctcagccccccaatagctgggacaacaggtgtgcaccaccgtaccaggctcattttttttttttttttttttttgtagagacagggttttaccatgttgcccaggcttgtctcaaactcttgaactcaagagatgcacctgcctcagcctcccacagtgctaagattacaggtgtgagccactgtgcctggcctcctatgttgttgtttttttctaaaggatttatagttttacattttatatttaatgtgatctgccgggcatggtggctcatgcctataatcccagcactttgggaggctgaggtgggaggattgcttgaggccaggagttcaggaccagcctgggcaacataaggggactttgactctacaaaaataataatacaaaaaagcccggtgtggtggggtgcagctgtggtcccaactgcttgggaggctgaagtgggaggatggcttgagcctgagagatggaggctgcagtaagctgtggtcacactactgtactgtatcctgggggacagtgtttgaccctgtatcaaaaaaaaaaaaattctgtgatccattttaagttaatttttatttaaggtgtgagatttaggtcatgatgaacttttttgtcctatagatgcccagttgctcaagcaccatctgttgtaaaggatatccttccattgaattgcttttgaatcttttacaaaaccatttgagcatattcgtgtgggttgtcttttgagttgtctgttctgttccattggtcgctgtgtctatccgtctgccattgccacacagtttttattactgtatctgtatagtaaaccttaatatcaggttcagttcttcctcccactttatttttctttgtcaagattatttgtcttttttttgtttttcctaatatataaagaaaattactctttaggtcagttaataatcttattctgctaaaaaaattaaaagatagcttttagagactgcatgcgttagtttgtaatgctttctcctgaaagtaatggaatacctgactaatagaggcttaaagaagcagggatttatttttttcaccaagtaggaagcctggaggtgttaccagcggagggtgttcaggttcttggcatcgtgaacaaagaattggacaaaatgcacaaacaaagcaaggaaagaattaagcaacaaaagcagagatttattaaaaatgaaagtacactccacagtccgggagcgggcggagcataggggctcaagagcccctttacagaattttctggggtttaaataccttctagaggcttcccattggttacttgacgtagaccctatgtaaatgaagtagtggcccagcaatcagtttgactggttgcggaaagcaaccaatcagaggctgaagtgaagttacaaaggttacaccctatgcaagcatctgattggttgtggaaagcaaccaatcagaggctaaagtgaagttacatagttacactcctatgcaaactttctgcaatcaatcagagatactttttgctttctgcagccaatcagatactttcaattttccatctgccatgcagaaaaaggtgggggtcacggggagattgcaaagggagtagcctcccttgggtctttttgttacttaggtgtggaaagttgtggttttccttttgatttagttctaagaagtcagcgtaaattggccttaggttccctgcctccagaccctattctcttgcttcagaggtagatggctgctggcacatgtatagaggctcagcattgtctcagccagcatttctgcaatcttgcccattatcccaagatggctgctgcagctccagggatcatatatacatttcaaggcaagaagaggtgaatgaggggaacgtgacctgtatctgtcccttggctcaagagagcaaaaatccttcatagaattccaaaacagactcctaaaaagaggctgaggaaacaagtgcagtgtgtagctttttctggagtttttaaatggagacttgcaagggagaaggaatttgggaatggctgcacgaatcagctaccgtgagccagtggtttcaacttactttgggtaaaatctttagaattctgtttattgattggtgccttaagttgaattatttagagcaaaaatatcatagccttatgagaaagattctgcagatctccagatcttattgatttaaattttgtttttcactctactgatttaaatacattattaaatgtataaaatcaatcttattgttatattgagttgatggctaagaatcatgagcacaacactttttcaagttacttttagaaagagaggaaattagcttaaaaaatgtttgagattttctttgacgtgcctttttaatttgcacatttggggttagtttttgagtgatttagcttaattaataagtaatgatggctttcatgctcttatagtcttacattcttagatcccactatacctgaggcaattttgttattttctctgggaggttcacagtatctgctgaatgactttttcttctccatgaaagtacagcaaaaaagaaaagaataaatgaatttttaaaataaatattagacgagggaggaaaaaaccccacactattcacagaatagaagcaaattagtccagaacctgatcaggcagaaatatctaagaatgatagttttagataattctgtatcaaattttctattaacctaaaaaaatagaaaaataagttgtgttaatgtttattgaaatattaaatattaactatctctcttcaattcccaaatttccagtaactgctggtgactgtagagggatttctacagcactctcttttaatacttccccagcttttaagggattgagtctagatccaattatttggtctatttcctcccttccgggtcatggtggatgtttttgctattatatttgccaaaagcaaaagtaacaattcaatcctgatgacttaaacaaggagacatctattacttttctcaaaaagcacaaagaatatgaggcccattgcttaagggctcaggtgttgggtttgcattcctggattcaccacttatactagttgagtgaccttgggcaaattactaaaactctgtctctcagaatccccatctaggccagacacagtggctctgcctgtaatcctagcactttgggaggccgaggtgggcagatcgcttgagcccaggagtttgagaccagcctagtcaacatggtgaaaccccgtctctacaaaaaatacaaaaattagccaggtgtggtggcatgcgcctgtagtctcagctactcaggaggctgaggtgggaggatcgcttgagcccaggaggttgaggctgcagtgagccatgactgtgccactgcactccagcctgggctacagagtgaggccctgtctcaaaaaaaaaaaaaaaaaaaaaaaaaaaaatcagactccatgcataaaatagggatgatgatagaatatactcagagatttttctctctgaggattaagagcattaaaaaatttgcatatctcatttattaatgaggttaactatattttagtatgtttattggctatttccatttcctttttttgcaaagtgccttttcaaatccattgcccatttttctgttgggttttccttttcttagtgtacatatatatgagataaagagtggtctttccatatgtgtatacaatgtgtaatgagcaaatcaggcatatttatcacctcaaatatttatcatttctttgtgttgagaacattcaaaatcctctcttctagctttttgaaaatatataataaattatagttaaacatattcatcctacagtgctacagaacaccagaactcatttcatctatctactgtaattttttatctgttaaccaacctctccccacctcctctccttcccctttccagcctttaatactcccaatgattaagagaatttaatgtggccagacatggtggctcatgtctgtaatcccagcactttgggaggctgaggtgagcagatcacttgagcccaggagttcaagatcagtctgggcaacatggtgaaatctcgtctctacaaaaaatacagaaattagcagggtgtggtagtgtgtacctgtagtcccaagctactcaggaggctgaggtgggaggatagcttgagcccaggaagtcaaggccgcagtgagctgtgatcacgccactgcactccagcctgggtgacagagcaagaccctgtctcaaaaaaaaaaaaaagtttaatgcttctaaagtgcttagaacagtgctacaattgttagctattgtggcaatagaaatgacatttatattggcttatctagctcatggcttatctagtaagctgtcccattcttaccaggcacctcacactacctgcctttgtcttgtggttgtcaagcatctgggcttttgagtgtaggctagaaagaaacaagagactgctgtgctggagttctgaaatagaggttgcaaacagatcaacagctcctgatgtagatgactatagccagcttctcagtttggattaactttacggtttctgtagcggccttgataactaattgattaatcaacttatgcatgtgataaaattgcccttccaatttttagcaacgaggaaggggtgctgattgtagctttgaatttgatatgaagcagagtctggatttggctgccacctttccaacagtggtggaatgggaatcagggagttgagatgccaaggagcactgacctaggatctaggaatagttatgttcctaactttatcatttgctaagacatttgctaatttccttaaattgagactgagtaccaatacacagtcactatggcaaaggcaggttgccatgccatcttaagaggctataatggcaaatctcaagtttttgtaagtgtctgggggtgtgtgtgcatgggggcaaacattttaaataagtgccctatggactgttacatcatatcaaacaaattctcaatgcgttagtttctaaggtatagaattctgaattgaaatttcaagctaatactctaatagtgcaaaaatggagttttgcatgctatgtcaattagaataacaatagcaattggcatcactggacttaaaaaaaagtgtgtgtgttttgttgttttgagtttgaatgtgtgaattcacaactcacaagccaagagttttggagaggttttagtaatagttcctttcatgctaaaagcattgttttaaataattacgtgtggctgattttattttatttagcaagagaattggaaatgattaacaggtatctggataatactctttgggtggagaatttgctcataaatttagctgcaacttggttgaatgaactgcattctgactttgatatattttggtttcttctcaatttttatagcattgttggattttatgggccccacatgcttccacacaactctgttggccttggtggattttaatgtttaaaattaaaaggccccatcatatattcttagttattgttactattatagctggacaaagatatgctggtaagagtttgtagcaattgtgtgtgtgtgtgtatgcaggggttgggggaggtgggtttgcagtggttgctgcccctcaaagaagcaagcatgtagctatccaatgggttcttcttacccactgcccagatagagccgatttctcaaaacagaggaattgcaatagagtttcatacactcagagccagctaaatgggagaccagagttttattactcaaatcagtctccctgaaaattttgagacagaggtttttaaaagatagtttggcaggcaggggcctaaggaatggggaatgctgattggttggtttggggatgaaatcatagggaattgaagctgccctctttcactgagtcaattcctggatgggggccacagatcagatgagccagtttacctgtctgggtggtgccagctgatccatcagaatgcagggtctgaaaattatcttaggttttataatagtaatgttatctatgggagcaattggggaggttagaaatcttgtggtctcaggctgcgtgattcctaagccataatttccaatcttgtggctaatttattagttttacaaaggtgatctggtccccaagcaaggagcaggggtttgttttggggaggggctgttatcatctttgtttcaaatttaaactatcaactcctcccaaagttggtttggcctatgtccaggaatgaacaagagcagcctggaggttagaagcaggatggagtcaggtaggtcacatttcttttactgtcataatttttgcaaaggaagtttcaggcatacctcttttgaccttgttttttccagccccttctctttctcttgcagctgtggtagtgagtaggaaaggaaggttagccttgtggagggctcttgaatttcaatccacctcttcagcctcctttagaaatactagcagaaatgagcctcataccccgtaagatgttgtttaagtgtctgattttgctatttaaggctctctatggattgatttccacattaactcttcaaagttcatgtcccactactataggaaatgcccctgtatctagctgggtctagtcctggtccttcaacatgtttcagtgtcttttactctgcccaaattcagtgcatggttcaaggttcactttaagactcaaattctacatgattttttctctggcatcgactgctccatagtatactcctttgaattcctgtaaccctaatctatatacatagggttggctgtttgctacagtggattgcccaaaaaataaatcataaaaatagatggtatgtttaagttgaagaactattgactcatgcctatcaggccctgtgttaaatgttgaatgtttcttattcagcatttaacatgtggccctgcttccatggaactaagaggaacagtgttaaaagtgacatttaacccaggaatgaagatcacataatttatgtatgttcatggagcaaatattattatggctaagaatgtcataaaagtggagataaatctataaatctatttgtggaaaagaacatataagctcttgggttggttagtaagggagtcatacttggtcccttttttttttagacggagtcttgctctgtcacccaggctggagtgcagtggtgcgatctcggcttactgcaacctccacctcccaggttcaagtgatcctcctgcctcagcctcgtgagtagctgggattacaggtacgtgccaccacacctggctaatttttgtatttttagcagagacggggtttcaccatgttggccaggctggtcttgaactcctatacttggtccctttttattggagctctgactcagttctctctaaaagccaataccaagtccttcctcttgagaaaacaaaataataaatgctaacaggcaggcacaggcacagatattctctcacttagtcctaaccactgtctcgtgaagcaggtattattattctcactttagacatggcaagcctctggagaagtaaagtgactgctccagcatcacatgacccatagaggcaaagctggaaggtgaatgccaggcttctgatgccaggtctcctgtcctatcctttatgaccctattactccctggtgctgctctccattccaaatgtttgattattagatttaagggggtctaagccaggtaacatgaacagggaaagatcagctgacaatatctgattgtttgaaaataatccacagcttatgttctattcattcgatagatgctcattgaacacctactatgtgcaaggccctatagtccttactgtcagaaagtacaaagcctagtataagatgcaagtatataaacaggaaactatagtataatatggtgagtacagtgatggctgtacaggaattatgggtatagaatgaatgaatcaagaatgaaccttgtgagattgtttgtctgtaccactgctgccctttcaaggagcacgtgtattattttttagaaaacattttattctctgttctaggcacttggcctggccctggtgatacagctgggggtgggggaggggaaagggtaagttcctaaatagttaaagagagggtaaccttccagactttaatagaagatctatgcaggaacagaatgttctgcctctggcagtcagagaagactttaagagatgacatttagatgatcttttatttatttcttgcatttttctgagcttgggttattttaaggaaattataaatactagaaactcaagagttttgatttgcaataccttacctagagctgttcaaagagccatatggttcacaagctatttctgtccccatgattctgctgaaaccattctcgtcaaggtcaccagccacctccatgttgccaaatcagggggtcaagtctcaagcctcgtcttcatttgaattattagtagcatttaacacagttagtcacgtgttccttcaaatgctttctttaggtagtttccatgatactaaactctcctggtgttcttcccatcttaccagctgcccctttttagtcttgtttgctaattctaccccatctccctgatcacgtaacattgggatattttaaagctcagtcttggacttcttttctgcactatcatcattcattccagcactgtagccttaaataccatccatcaactgatgtatatcaaatttttatatccagcctcgacttcttgcttgaacttcagactcccatatccacctgctagtccacatttctacttgcttgtctgagtggtatcttgaatgtaacatgtccaaaatagaattctggactcctgtgcctgcctcctacctccagaattctcatttaagttctctcccaccattctacatcccagcacctaaaactccattcttctcgttgttcaggccaaaatacttggggttgttaataactcatctctttttccacaccctacatctaatctattggtaaatcctttttgttctaccttcaagatacatacagaacttgatcacttccactgtctctacttctattaacctggtctaggccactatcatttcttgcctggactattgcaatatccccagttctttgtattgtggccagagcgatcctttctatgccctgctcaaaacaaaatccagtgttccttaaacctctaaggcactggcccctgtttatactcttaacctcatgtctcaagttagaggactctagacctttcaaacaccagaataatgtggtgtcctgcaaggtaaggcctaacaggggaggttgtatgataatccagagtgcaggagtgaatggaggggagaagggactctcggtgactgcagactactgtttcgtgaaacatgaagatagaggatgggagggagtcaagatggtaacgaaagcaagactaagggcactgaaggaggcttttcttcctctaagagttgaaagacttgagtgtctttatgagttcattgaaaggaggccatggaagggagaggctaatgctgttgatcactgacttatcagggacacaagtaagccagtactgcaaggagagacagttaggacccacgtgaatatggaaatcataaattgactgcagtcacttttgtttgcttagttgcatggctttatcccaccacttcactctgtcttctggccagagccttctaattatcttcagtctactaccagcccttttgttatgcctgccagttaatcccagtgccttctcccttgttctgctccaggctcctgaacactgtggatgtgacacaggtcctgagggtcacattgcttcctggatcactattctttgtctcttaattcctgccctcctcccaggtgctttaaacttatctactccaagccagttgcagtggctcatgcccgtaatcacagcactttgggaggccagggtgggtggatcacctgaggctgggagttcaagaccagtctggccaacatggtgaaaccctgtctctactaaaaatacaaaaattagctggttgtggtggtatgcacctgtaatcccagctacttgggaggctgaggcaggagaattgcttgaacccaggaggcagaggttgcagtgagccgagattgcaccactgcactccagcctgggtgacagagtgagactccgtctcataaaaataaaaaaataaaaaaataaaaaaaataaataaaataaataaaaacttatctgctcctgtgacatttgtttgatagggtcagaggctgtgaaactttagaagcatacatgctgtctttggaatttaaaaaatgtatctacatgccaaccgatccattatttacttaatatctctctgtgaattgaatcacttttggaaaactaaaacatatttaaaagggaaactttatatccttaccataaatgaaaaccacatcatttgatctaagtggaaggtcatggtaagaaaaaaagaaatgaaaacaaaacagtgtttttagatttgatgcctacaaaaagttaggagcctgaggcctgctttcttttttataggcaagtatttgggaggtatagtcagtactaccaaattgagactcacccttgccttaatcgaaaggaagaggatagaggaagatgaacattcttgcgcgccctctgaaatcgtctccattaccaactagggtggcatccctggaaagagtgaggcccgggtgtttgtgtgcagagacagcgcaagggttggcatgctgtggcttgcttaatcagtttcagtttaagattggttgaagatcttcatgttaagatatggcagtggcctctttaaaagtcttttgtgcccggcgcagtggcttatacctataatcccagcactttgggaggctgaggcaggcggattacttgagcctgggagtttgagaccagcctggccaacgtggtgaaaccccgtttctactgaaaatacaaaaagagccaggtgtagtggtgggcacctgtaatcccagctacttgggaggctgaggcaggagaattgcttgaacctgggaggtggaggttgcagtgagctgggatcacgtcactgtactccggcctgggcgacaagagtgagactctgtctcaaaaaaaaaaaaaaaaaagtcttttgccttcagaccttcccccttccaacccaccctgcccactgttagtggatctgtcttcagacgtgctgcctcatattgtccctgtgtccctcgggaaactttaatggctccttgttgcctatttgatccagaccacaatgttcaatttggcaaccagtgaatctaccactcaagttttatgggcttcctgtatctgcagcaatatgttagatggtgaggggacatagaaaaaggcagaaatatacaccatggtcccagagtttaaaaaatgtgtcatctagttgagacaaatcaaacacgagtatgtgcacatattatggtgcatgtacacgacgaagggctggtggtcagagaaggcctcatgaatctgcccatccctgggcttggtcatcatatagctcatttgtggtgtgtgaatctcatgctggctggggttttcttttttattgtggtaaaatatacaaagtataaaagttaccattttaaccatttaaattatacaattcagtggcattttgtacattcacaacgctgtgcagctgtccccactgtttcaagaaaattttcatcacttcaaaggaaacctgtacccggtaagcagtcactccccattctttcttcctcccagtccctgccaaccattaatctgccttctgtctctatgaatttgcctattttgtatatttcatataaatggaatcatataatatgtggccctttgtatctggcttttttctcttagcataatgttttcaaggttcatccacatggtagcacgatatcagtgctttgttccctttggcggcagaataacattccattgtatggatataccacaactgtttaaccattcatcagctgatagacatttgggatgtttccaccttttggctattgtaaataatgctgctatgaacatttatgtgtaagtttctttctgtggatgtatgttttcaattctcctgagaatatactgagaagtgcaactgctggatcatatgatgattctatgtttaacttaatgagaaactgccaaactgttttccacagcagccatactagtgtacatccccaccagcaaggtgtgacagttccaatgtctccacatcctcaccaacatttatttttcattttaaaaaaattatagccaccctagtgaatgtgaagcgttatcacagtatatgtatgtatatatgtatttatttttgagacagggtctccgtcgcttaggctggagtgcagtggtgcgatcatagcttcatagctcactacagcctcagcctcgtgagcgcaagcgctcctttcacctcagcctcccgagtagctgggactatacgcatgcaccgccatgcctggctaatttttgtattttatgtagagacaaggtctcaccatgttgctcaggctggtctcaaactcctggactcaaatgatctgcctgcctaagcctcccaaagtattgagattacaggtgtgagccactgtgccaggcttcattgtacttttgatttacatttccctaatgactaatggcattggacatattttcatgtgcttgttggccatttgtatatcttctttggagaaatgagggtcgtggtcaactcagtataccactggaggctatatgagtaaacagcaaactttctcataaatgcagaatgttggcaaactgacaaactgcgtctgccacccagaaggaatgctgagggcagttatgccccaagtgcagtgtttattgtgattaggtacatcagaagcctgttagtaataatatgaacctgtgatcaattaaggagctgaccaatcattacctcctcctccctactcattctacccaataaatacgaagggctgtggaagctcaggggggctgcctttgctcactagaagcagggagctctcttcttccccggacccttcctttaaaacagtttcttttgtcttaagttttcatttctatgttcatcccccttcgttcagtctcgtaatgacggtctcaagtagtaacaatagtaactcttgtaatgacggtctcaagtactaacagtagtaactgttgtaatgacggtctcaagtactaacagtagtaactgttgtaatgacggtcttaagtagtaaaagtagtaactgtcgtggtgacagtctcaagtagtaactgtggcagtctaccacatcctttgcccatttttaaattcaattgtttgtgtttttgctgagttgtgagaatctttatatattctatataatagacccttatatgatttccaaatattttctgtcattctctgggtttctctgttttttagaaatgacatctcactctattgcccagggtggtcttgaactcctgggccccagtgattctcccagcttagcctcttaaagtgttgctgggatacaggcttgagccacctcacccaaacttcattctatggattttttcactctcttgatagtatcctttgacacacagttctaattttgatgaagcccaatttatttttccttttgttgcttgtgcttttggtgccacatgtatgaaacccattgccaaatccagagccatagtgactggcttctattctagggttgggagctgtggcttgcccaaggccatgtccccaaagtctctcacaacttagcacccaatggatgctcaccagatgtttgtagaagggatgactatgtagtgggatgtgagctgacccttggtggggagaggggtttgtgtagaagtatagcctgaccagggacatgactttgaatagacattaaggtaccttataagctgtaagatgtggtctgaccaaagaggagggtacacatgaacaaattgtggaattctgggggacaggtagctgagtgaggccttcaacggtggcaagggctttttccatgtgattatggaaacctagatccatggaggaaacttgtgagtagtggagaaagctcctcaggggaaggaaggctggctgtgacttcatctttataccatactctctagaatagggcctggccggtattaggctttagtaaatattccagtggcctgatgagggagacttttaagatatttacatgagaggcttttcatgatatagtcctccttatatattctactctagctcgccctccttccaaacttgaccttgactttctttttttaccagattcgcccctctcctaggtgctgtcagctcagctgcagtacatcactcctaaccctgcttggaacatccttgcctctcctctcctatctaattcatctcattcctccaggcccaagacagtatccagttatccacagaacctcaacactactactccagcacatcagtgtatggctctagtcagccatacacttagctatacacttaccagagcttagggtcacatgatcttaggttcagatgcaggctccactagttactgtgtaagcttgggtgggccagtctccctctctctgccttggtttcctcattggaaaaatggcagtaataacactgctaaaacagttctgtgacagtgaaatgagataataaatgagatataaaacccttagtaaagcatccagctcatagtaagcggtcaaaaatggtagctgtactgttttctagttgtttgctgtatttggctgttctcgtgttgctataaagaaatacgtgaggctgggtaatttattaaaaaaaaaaggcttaattggctcatggttctgcaggctgtacaagaagtgtggtgttggcatttgcttctgatgagggcctcagaaagcttccaatcatggtggaaggcaaagggagagccagtgtatcacatggtgagagtgggagaaagagagagaagggggaggtcccagactcttttaaacaagcagatctcatgtgaaataactgagcgacaactcatttatcactaaggggatggtgtgaaaccattcatgagagatctgcccccacgatccaatcacctcccaccaggcccccacctccaacactgagaatcacatttcaacatgagatttggagaggacaaacatccaaacggtatcattttatatatctaaatcttgcttcctccgcaagattgtgggtttttttcttcagggcaggggctgagtcttatgcttattttaactcgtatatttggcacaaagttaggactatagtaagtacttaagaaacatttgttggttcgaggtgactttgtgattactcggagttacttgctttaggagacagtatatcattattgaattctatattattctacgattcattttctgaaacccaacttttgctttgttttatggggatctgggactgacttgtggtaatctgattgtatgtgtgagcaagtgtgtgtgtgtgtatgtgtgagagagagagacagagagagagagtggagggaatggtggaggtagcgacaattgattccctaagggacagagccagctacagctcaccatcctaaccactgcatctagctttcctctcccagccctagagctgggctgttatctgcccagggcagctgttatggccctgactcccctggggagggctgctcaggccttcctcattcttccaggctgcctttaccacaaaaggaaatgaggtatttttgaccttatcagacttctctgccaaggcatcatgttttgcaagaggctattgccctggctatatacagtcctgggcagtgtgctaacattaaagaagcaaattcaggataatggttacctctggataagggaggcagggctatgagctctgagataaagcttcagttatctctgaggtatttattttttatgcagggctgtggggcatatgagtgttcatttattatcatgaacattgtataatcttgtatttgctgcttatcatttctatgcatgtattatccataaatattaccgtatttttcgagtattttccagctttacatatgtgtcgtgaaattttatgtgtacttcagctacctatattttttgcctggcagtttttgagatttgtctattttgtttgtttgtttttttgagatagagttttgctcttgttgcccaggctggagtgcagtggcatgatttcggctcactgcaacctccgcctcccaggttcaaacgattctcctgtttcagcctcccaagtagctgggattacaggtgcccaccaccatgcccggctaattttttatatttttagtagagatggggtttcaccatgttggccaggctggtctagaactcttgacctcaggtgatcctcccgcctcagcctcccaaagtgctgggattacaggtgtgagccactgtgcctggcctagatttgtctatattgatacgtgtaatattagactctgtattaatattccatgttataaagagatgtatcttttctgctattgggtagacatttcagtggtttcctatttttcacttttgcaaacaatgctataacaatagtctgatatgcagttccttgtgcctaagacaagatacttctgtaggagtggattggctaggccataggacatatatgcctctctctttgctcgtattgccacatcgctcctcagagtgattgtcctactttaccttcccaccagcagtgcacaaatgttgatgttggccatgtccttgccaacccttggtagttgtatctgtgctttctcctctctctccagatcaccagaaaaggtgggagttaaggtttttcaattaaaggagaatgtcagctctgaagaatttcctgttacatttactttaatgaggaaaagattttgttctctgttttggtgaaaataatgtttagacttctgtggaaaacagttacatacactttttattctgaagcagagcagttttttctttctttctttctttttttttttttttttgctgtttgcattcttggcaaacaagtaggaaagaccaattagcaagctaatgttctaaatatttacttgcagtaacagtcattttttaatgttttatatagcatggaacattaggtttatgtgtactgcttttcaatgttttgaattgattaaaatgaattaaatttaagaatgtgacacaactttatggataaagattgatcataattatttgccactttatttgcattttgtgagggaaaaatacatggtaagaaaatgtgttgacattttacaaacaggttagaaaagtcataaagagtaactttggctattttatgttgtctcttatgttcacaggtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtaagtcacatgacactgggaggaatgcagtcttagcattttacagatgctaaataatttagttttgagaaagtaggagtcttcagtgtaaatgttaaggctagttctttttctttttgccttttctacttattattgcctttatttttagtgttttatttttagtgtttctccctttgtctttatttgtttaaattgacaaacataattgtatatatttatggtgtacaacatgatgttttgaaatatgtatacactatggaatggctaaattgagctaattaacatatgcgttacctcatgtgcttctctttttttgtgatgaaaacactattgtcttacaattttcaaatatacaatacattgttattagctatagtcattgtgttatacaatagatctcttaaacgtattcctcctaagtgaaattttgcttcttttgactaaggttagttcttctgaaaagataaattcaagaacaaaagtatcctaaacaaagaaaaatcattcttgctctgctcttttttatcaggcacattggttgcagaatgccaaatgtttatctttcttggctaatgcttattaacctttctctcatctccttcactggacaggataatctgtcctatagaaactaagagtctcgtcagattgtcacttttgcttttgagttgccattgactaaataattgtgtttgagtctgaatgtggctttaaataggaatagaaaaatgccttctcttcttttctccatactaattagtaataaaccgtagtaatgattccccatccctaagggctaaaatgtgatgtggcaagaagaatagtgaaaggaagtgatgccattattagacaagagttggaattttttaatgtatatgtctatacacatacacacacatatacatatggacatattggcagttagaaaaaggaatgtatttgaatattttttaaaaaggctaagatcagaggaaagaaaaggcgaccagctatatggatatgctgtgtttatcagatagccctgtatcacagcccaatgttctgttctccagaaagaactagttattagattattttagatcctgtaattgaaagatagttcaggactagataaagaattgaaaccatagcatgctaagtttaccaggtggtttttagcagcttttaacatggattggttggcagtactttgattctaattaaaatgtcctcaaattgacacatccccatgtcatctgtgatagggtagatcaattagagtgcacatttttttttgaagcctagttctgacacttatagtgatctaacagaccacagggaggcttccttcctgggaaaccatttctcctttcaacatgggccaatattcttttcttggattattttcagtacctggctcagtgctggacccaaagctcaaaaacaattctgggctgactgacttgggtggattatgcatagttttctgttactctcaatcttataggatgtttactttgcatgggccaaagaaaagattctatttttacctcatgtaaaatagagggtatcgacaatattttaaactaatccactactgaataagtatcgtaggccacaatgtattaatattaaactattctcttgcatttcaagtcgaaaagtcatttcatgtttttctcaatatttaatatgtgcctttcaagcctattttgcaggcctttaattacttatgtagaatatttcatgaatctggaataattttagcttcagactacttgagtaaacgaagagcttgctcatttcagggctaactaaatgcaacataattctttcagttattttgttggtcaacttctattaaatattcattgagctttaaatgagacactaagactgaaatatttacgtgctctgatgagactgtgaactacagactagatcctggttaataccccaagcaaattataaagcgctttctacattagcggttcaacaaaaacaagtcaacacttgttaatcatttgtcttaaaaatgagacattttcagtgcaccccatcccagccgcccggtcccggcccctcactctcctttgccgcgctaccaccatgctctccgtccgcgtcccgctgctgcacattacggacccgcagcagctgcagctctcgccgctgaaggggctcagcctggtcgacaaggtgaacaggccgccggccctgagcgggacccgggttctggccagcaagactgcatggaggatcttccaggagcccgcgagccgaaaactaaagcagctgcccccggcgtggaggatgagccgctgctgagaggaaacccttgccgctttgtcatcttccccatcgagtaccatgatatctggcagatgtatgagaaggcggaggcttccttctggaccaccgaggaggtggacctgtccaaggacattcggcactgggaatccctgaagcccgaggagagatattttatatcccatgttctggttttctttgcagcaagtgatggcataataaatgaaaatttggtggagcgatttagccaaatagttcagattacagaagcccgctgtttctatggcttccaaattgccatggaaaacatacattctgaaatgtatagtctccttattgacacttacatcaaagatcccaaagaaagggaatttctcttcaatgccattgaacgatgccttgtgtcaagaagaaggcagattgggccttgcgctggattggggacaaagaggctacctatggtgaacgtgttgtagcctttgctgcagtagaaggcatcttcttttctggttcttttgcatcgatattctggctcaagaaacgaggaccgatgcctggcctcacgttttccaatgaacttattagcagagaagagggtttacactgtgattttgcttgcttgatgttcaaacacctggtacacaaaccatcggaggagaaagtgagagaaataattatcaatgctgttcagatagaacaagaattcctcaccgaggccttgcctgtgaagctcattgggatgaattgcactctaatgaagcaatacattgagtttgtggcagacagacttatgctggaactgggttttagcaaggttttcggagtagagagcccatttgactttacggagaatatttcactgaaagactaacttctttgagaggagagtaggcgagtatcagaggatgggagtggtgtcaagtccaaaagagaattcttttaccttaaatgctgacttctaaatgaactgaagatgtgcccttattttgctgatttttttccatctcataaaaaaaatcagctgaagtattatcaactagccacaccatgaattgtccataatgttcattaacagcatctttaaaactgtgtagctacctcacaaccagtcctgtttatttataatgctggtagtatcaccttttgccagcaggcctggctggctgtgacttactatagcagtgacaatggcagtcttggctttaaagtgagggttgaccctctagtgagcttggcacagcaggattaaacagtcatttaaccagcacagggagttgaaagttgaaagatgcagcctcactgcttcagcgcagatttcaatgtttacttaaatataaaactggcactttacaaacaaataaacattgtttgtactcacaaggcgataatagcttgatttatttggtttctacaccaaatacaaagcattctcctgaccactaatgggagccaattcacaattcactaagtgactaaagtaagttaaacttgtgtagactaagcatgtaatttctaagttttattttagtgaattaaaatactcgttaaccaactttaaagtcagtcctgtgtttagatagatactagtctgttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttttttttcttttttttttcttttaatacaagaatatgtctctttttattgaggtcttttttatgtgctatgattaaattaaatgagataatgctttaaaagcacttatatgtgggagctaaggtagtattgtaaaacttcaagtcatccttaaacaaaatgaccaacctaagatcttgctcctgttaagtggtgaaatcaactagaggtggttcctacaagttgttgtttattctagttttgtttgtgtgtaagtacgttgtgtgagttaattcatttatatttactatgtcttttaaatcagaaattttttattatgtatgtccttttagattttacctgtagttcatactttaaaataatcacccagtgtcttattctagcattgtctaaatctgagtattatctaggggaatcttaaacttcagtaggaaaccatgagttattcatacagtttccattcaaatattaatttcagaacgaaacaaaatttttttttttttttgagacaaagtctcgctctgtagcccagtctggagtgcagtggtgcgattttggctcactgcaacctctgcctcttgggttcaagcaattctcctgtctcagcctcccgagtagctgggactgcaggtatgtgccaccacacctggctaatttttttatttttagtggagatggagtttcaccatgttggtcaggctggtctcgaactcctgacctcaggtgatccacccacctcagcctcctaaagtgctgggattacaggcatgataaacaaatattcttaatacggctactttgaattaatctgcctttatgtttgggagaagaaagctgagacattgcatgaaagatgatgagagataaatgttgatcttttggccccatttgttaattgtattcgctatttgaacattgtcctgttctattgttagtttccttcatcatttatggtatagtcaatttttaaatctctgtaatataatacattttcctatcttttaagttattgttacctaaagttaatccagattatatggtccttatacttgtacaacattaaaatgaagaaagccaaaaaaaataaaagacgttttcaacttgttgccagtttttccagtagcttttaatcctagcaatatatctagcattacactctcaaataatacaaagtaaaaataaagacagttctttggaaagtgtattaaaattaatatttgtagtagatgctctttgtgcccacccagatccatgctggggtggtgatcccccacccccagctgtgacaaatggtttgacaaacagctcacacctgtaaccctctctggagacttgctcttggctgatgggagttgcatctctcagagacacctgagaggttacactggcccctttcccctaagagggggcagctaataactgatttatcaagggtaaaaaaaggtcagcttccttgcctgaaggggggataattctttgctatgattcaggctccatagcccctcgtgcatcagaccaaggctacacttgacctgagaatgcatccttgcttgcgcggttcatttccctttcctttgctgcttccctcactcccttacaggtttctcccaagagtctgcccttaataaatcacatgcactaaaatccctgtttcaggctctgcctctatggaaccccaacctaagacaacattccaggttttaatccataattctgaaagcaaccaccaaaatgccttgctcaagtagactatcacattacaagcagagaaaatgccttttgcaatcatgaaaaggagccagtatttgttatcccgcatggcccctgcggcagacacttctagctgtttatcctttatgcattctacccttccttcttataggcagaacggttttatgcaggctggaattgtgcccacttaaatgtgttacctccccaggctccttgcagctagggctggccgcatgactcacttttggccaatgatatatgcattaagatttattgggtggggctcgtgggagagttactatttttctaatgaaaacaggctcagcaggtatgattttcctaccctttgccctccttttgtttttcctgtctggaactagtgttaccgaaccaaactgggtccatttacctgcatgcaagggaaagccaaacgccaaagcaccaggtttttgcagcaagaaaggtttattgagttgattggcaaggagacaggaggaaacactcaaatctgtctcctggagctgggggctgggtcgggttttataagcatagtgtaatgaggtgtgatctgattgcatcttgcaatgaggtgatgctgggaggcataatctgattggatcctgctatggggtgacaccagagcacgatctctttggttcctggatcctgccatatggggtccacttcttaattcagtccctgttccttggtccaagcacttaggtttcacctgtgcacacttggttcaactgggcatgctcgggttgtatgaccttcaaccctggggtccacggcaactgaaaaacaactcacgattttgttttataaaagttgaactagattagtctggtgcggttacactaggacataattcctagggcacagcagctatcttgtgagcatgacagagataaaggaaacctaggtccttgttggcatcatggagccactgtttaaggcccaggctgcctctctttggacttgtagttatgtgagaaaaatcaggctatatttcagagattctcaacctagcaaggtatttggaaatatgtggaggtgttttgagttgtcacaatgatcaggagcagggccagactagggtaaggcaaatgaggcacttgccttcggtgcaacatttggggtgccccaaaactcagcaattaagctagataatattttattatctaattattattattatctgttattaagctagtataatattttaaaaaatcaaattaatgccagaaattcatgatgaacaaaatgccaacattttaaataaagacaagatcagcaactgtgccatggaagttatattggagcctgaggcaaaaggaaaaatcagtaatactgatccaatcttcattaaaaatttggcattttgatattttgtttctcctggatattttgcattaattttgttttattttattatttttttttgaggcggaatctcgctctgttgcccaggctggagtgcagtggcacgatcttggctcactgcaacctccgcctcccaagttcaagcgattctcctgtctcagcctcccgagtagctgggactacaggcacccaccaccacacccggctaatttttgtatttttagtagagacgggatttcgccatgttgaccaggctggtctcgaactcctgacctcaggtaatccacccccctcagcctcccaaagtgctgggattacaggcatgagccaccacgcctggcttgcattaattttgatgttttaaatcgcctcaccctagggccagccctgaccaggaggtgctgctaccattgagtatccaggggccaagtgtatattttatatcctgcagtgtggggaaggcaaccctacattggggaaaaattgttctacctcaaatgccaatactgtttccaccgagaaacacagtgtgtgtactacttgcttaaaacccgtagcattgggagaatttctaaaaacaggcaaaagaattttgcttaatactgcacccacccttcaaagacttcgttatttcattgaattcatttaaataaaagcagactatgatggggccaagacaaaaacaagactattccataatcataactgtctgaacacagaacacgaacactgtccaagtcacaaaatgcatcactcacgccagttatttccagtcatcatcccagtacctccatgagtaggaagcaaatatagacggttgtcctcatcatataaatgaagaatcattctcaaggagaaatggagcaggaaccagagtctgagactgggtgttggaggcactgattctggttctggtcccgccattaactatatgtgtgattgtggcttagtcactttacctctctgagcctcagtttccttaactataatgcaggacttggctagctgatctgtaaggcccttttacctctggcaatttacgtctaaaacttgactaaagtcaaattcagcttgtttatcctagaactgagcccagaccctggatctaatggcctaggactctctaattacatcaggcacccactacttcattattaattgaaatttggcatttagcagtttatgctacgctatggtggctgtataagatctatagttagctgcttttataaaacgttggaatatttagaaatatacaaatgactgaatgtttttatatgactttcgtctggaagttaagccccatttacatagactctacaattttgctctcatttttcatttgtcaacagctcctagttagcctaatttgtttgctatttcacaaatgactcagttatagtaagtggcaagataaaagttgatcttatgggatatgcatacatttgaaaatattatttctttttttttccatctattgtaaacataatggttataatcaaaactactgaccgcacaattgaattttaatcacttacattaattgacatcgagcttgtaatgagctgattatttatgtagctgattatttatgtagctgtgtgactctatgatttgaacaatataaaaataaatttttaaaatataatttggtcccctgggtcatcttgatttttttttttttttttagattaaacaagttagtttattattcatttgcagcaagggaaaaaacataccctaagcaactgtgggatgtctaatgaagcaggtgttagaaaaggcttattataggatttgggcttgtgttaagtaattgtggggagtgattaaggaagcagggctttgctctggattgggtgctatcaggaagtaggggtacatctacaactgggtatcttaataaatctcagagggagagaacagactagagtgagtctatacctataattgggagagaagcagctgtcacttctgtgagccaggagagggggatgtttgacatttcatggctggacaaggttcattttctgtgtttagatgtgactgtggagtggtcttggttttgtcttgatccgtcacggtcacagagtggccttgtctgatgttggtggtctctgaaattattcttgtttagcaggagaacaccaaggcctagctgtggatgccaggccagcttgtaacagcaccaagaccagctgatagtataggccggctcctggatgtcaggggctacttttctctttcttacccagtactagctagaatttttaattttcctgcggtaggattaacgaatgatcaggtacattataatttcacttgcttaacaaagaacaatacgtaaatacagattcttgaagttttgcctaaagccagttaggaatgttataaaatataatcagaatatataaaaataaaatacaattaagcttttaaaaaaactggaaaatacattagatataccattaaaccatacccgaaatttcaaatggaaatctttctataggtttatataattctcagattatctgactcttgctattaccatgtcataaaagacaccaacatgtataattataagacaacgtaattgcaatacatttgccgttttaatcccatgttttacatcacaagtacacagatcttcagctatttagttttagagaagaaataaaaaatcttgcctgaaatcaaccatgtcataccccaaattctcaactatgcattctgcatttgtcactaagaataaaacacttagtctttaaatttatattaaagtgataaagcttccaatttcattgtattatgtaggtttctttaatcttcttttgaaattcaaaaggcacttaataaaaataatccccaagtctggaataaatgtttttggaataaaaagaatgagaatcataaatgagccttttactaaagaagagagttcttccttccctcttttctaaaacctagaatttagctatttgacaacattttaaggcccttccctcaggccaaaactttttatcagtaactaggcctgtggcttattctgattagtccaaagttaaaattgtctttttgaactttaacttttgtaggtaccactacatccccattagaatggctataattttaagactcttaccactaagtgtcggtgatcatgtagagaaactagaaccttcatacattcctggtaggaatgtaaaatggtgctgccattttgaaagacagtttgacagtttcttagttaaacatatacttgctgcatgacccagtaattccacttctatgtatccatctaaaagaaattaaaacatgttcacacaaaaacttctgtgtgaaatgtttatagcatcattattcgtagtagccaaaaaacagggaacaacccaaatgtcccttaagtaataatggataaacaaaatatggtatatctacataatgaaaactatacaacaataaagaaacctaatgatatatatgttacaacatgggtgaacctcaaaaacattacactaagtaaaagaagccagacacagaagacttcctattatatgattccatatatatgaaatcctagaaaaggcaaatacataggaaaaagcagatcagcagttgactggggctgatggtgggagaggggacttttgtgggggaagtgatagaaatgttttaaactggattgtggtgatgattacacagctctgtaaatttacaaaaagccattgaactgtatgcttaaaagtagtaaattttatggtatataaattacagcttaaaatattagtttgtttgggttgccattgtaactgcccaactggttcaccatgcctgctgcctagacagagcccatttatcaagataggggaattgtaatagagaaagagttattcacacaaagctggctgttcaggagaccagagttttaatattactcaaatcagtctcccacaaaactcaggaattgggttttttaagtataatttggtcggggggggagtgggttggaaagtggggagtgctgattggtcaggttggaaatcatagggagttgaagctgtcctcttgcactgaattgttcctgggtgggggccacaaggccagatgagccagtttgtcaatctgggtggtgccagctgatccattgagtacagggtctgcaaaatatctcaagcactgatgttaggttttcctttttttttttttttttttgagatagagtctcactctatcacccatgctggagtgcagtggcgtgatcttggctcactgcaacctccatctcctgggttcaagcgattctcctgcctcagcctcccaagtagctgggactacaggcgtgtgccaccacgcccggctaattttgtgtatttttagtgtagatggggtttcactgtgctggccaggatggtctcgatctcctgacctcatgatctgcccgccttgacctcccaaagtgctggtgttacaggtgtgagccactgtacctggtgatgttaggttttataatagtgatcttattcatccccaggagcaatttggggaggtttagaatcttgcagcctccagctatatgactcctaaaccataatcactaatcttgtggctaattcgttacttctgcaaaggcagtctagtccctaggcaggaaggggttgttttgggaaagggctagtatgtttttgtttcaaagtttaactatacactaagttcctcctgaagttagtttgacctatgcctcagaatgaacaaggacagcttggaggttagaagcaagatggagttggttaggtcagatctctttcactgtaataattttctcaattatgatttttgtaaagacgatttcaccataacaaaatactacagactgggtggcttaaacagaaattttttttctcacagttctggaggctggaagtccaaggtcaaggtgctggcagggttggtttctcctgaggcctctcttcttgtcttacagatgactaccctcttgctgcctcatcctctgtgcacactaattatagttattttgaacataaaatccttgtcatttataagattttagttcacaaattaggaagaaactgatagtcactatttgacttgttgacttaaattttaggctgatttatattttgttctgaacttttaatctataaaagtcatggttatttatgtattcttcccccccgagttcaaaccagctgcaagtttatttgaaatattaaaaaaaaaattatttaccttcctttattttgtatttgcaggactctgccctatggtaaactcactttttgtaacgctgatggtgggtgatagcacaaatgccatagaccatataatctagctgtattcttaaaaaaattttttttaaagtaattttggactcacaaaaagtcacaaaaatagtacagagagttcctgaatacccttttcacagctttccccgatgataacatcttatataacagtttgatataccttatcaaaaccaggattttaccttctgcaacatggtaaaacaagaacaaaaatgcaggaaatcagcattggcattgtgaaccccaaagtatctgagacaggtctcaatcaatttagaaagtttattttgccaaggttaaggatgtgcctgtgacagcctgaggaggtcctgacgacatgtgcccaaggtggtcggggtacagcttgctttcatacatttttagtgagacataatacatcaatcaatatatgtaagatgtacattggtttgatctggaaaggcgggccaacacaaagccggggagaggcttccaagtcacaggcagattcaaagattttctgattggcaattggttgaaggagttattatcaatataaaggaatgtctgggttatgataagggcttgtggagaccaacgttttatcatgcagatgcagcctccaggaagcaggcttcagacagaatagattgtaaatgtttcttatcagacttaaggtctgtgttgacgataatgctggtcaacttttcctgaattccaaaagggaggagggtataataaggaatgtctggttcccccttcccatcatggcctgaaactagtttttcaggctaacttgggaatgtccttggcctagaggagggatctgttcagatggctggggggcttagaattttatttttggtttacagtataatactattaactaaaccgcaaactttatttggatttcaccagtttttacatgcactcactttttcccccttagtttaacagtcctgtggaatcttatcccatatatagattcatgtaaccaccaccatgttcaggatacagaataactgtgttctttaggattttgctgtttgagtcctcatttattgaggtaaacttcattttaattcttaaaatcaactttattgaggtataatttatatgtaataaaatgagcctttttttttttttttttttttttttgagacagagtctcactctgttgcccaggctggagtgcaatggcgcggtctctgctcactgcaacctctacctcctgggttcatgcaattctcctgcctcagcctcccaagtagctgggattacaaacgcccgccagcacgcctggctaatttttgtatttttagtagagacggggtttcaccatgttggccaggctggtctcgagctgctgacctcgtgatctgcctgcctcagcctcccaaagcgctggcattacaggcatgagccaccacacctggccaaaatgagcctattttaagtatacaattccattagttgtgacaaatgtatgcatctgtgtaaccaccaccccagacaccgtctagacgtctctgttgcctcaggaggttcccttattcccccaattcgtttagccctttcccattgttctgacttctatcaccatagcttagtctttcatttttttctcagatttcagataaacggaatcttatggtgcatctgccctggaatctagcttactgtttgagatttaagatttgaggcgcagctttgacaatgtgtatataaacaaagtgtagcaaattcatgtaataatatactataacagatttctgggcattttacagtcctttttagtcctctggtttgatatccctttactttaaaacattctgcttcagttttttcaaattactcttctaacctccttcagaggttttaaaatactttaagatgttaataacaccacattattcaaagatatgaagaaatgcttatctccattcttttttcaatgttgtcccatttccttttcttttattccatctctctcaaccttcttgtcccttcccttctggtgttttttttttttaattttatttttatttttatttttttaccttttttctgttttcttttctcttttattggacttctgtctcttcatcctcattctctttactttcatccatttttattcatcttctattgtgagtgccctatttaactttcttcctttccttactttgtcttcgcctgtttctggccttgcagttgctgacttctcttcttaggagagtatcatcattgttgtcatcatcatcatcatcggttttttttttttttttttgagatggagtctcgctctgtcgcccaggctggagtgcagtggtgcaatctcagctcactgcaacctccacctctcggtttcaaatgattcttctgccttagcctcctgggtagctgggattacaggtgcacgccaccacacccagctaatttttatatattttttttagtatagatggggtttcaccatgttggtcaggctggtctggaactcctgacttcgtgatctgcctgcctcagcctcccaaagtgctaggattacaggtgtgagccactgtgcccagcccatcattgatattattattactagggcctttccccttcccctttcccctagggctggacccagggtatatatgtctctccaaatggagtgttgtctgaaattaactctgtgtgcagtgtctagggtgttctttggaaacatggcctgcctgcaatacctccttaatgagaggctctttggtatagtagaaagaacaaggcttttcagttagactgaggtttagaacctggatttaccatctattacctatttcatcctggccatgtttttaacctctcttagcctgaattccctcatctgtcaagtgggaataacaaaacccaccttagagttgccgtgagtatcaaatgggtaatgcatgtcaaatgcccaggtcatagtagtcacgaagaattatttccttacatggggtggggagagcagttttcctaggggaagtgaagcataagctgggactatcccaatgctcatttgtgctacaggattcttgcatttttctttgggaaaaattctgggattttccagaagaataaatttggagatgctaccactgagcccagtgagttctaaaaagcagctattaagctatcattgtattgctctttccaattgttctgggcaccatttatgttgaaattagggtagttcataaaatcatatattgtttaaacaaaagattttgtcatgtctcttctattttagcaaatttacttaatggtcttttaggaggaaaggtgataaataactaccttttaaattattttattttttcattattctgaactaatagcagtcagtaataggctgctacaactgtatttacatgcctattattcataactgtactcatagattttataccatgatcctctaggttctagaaatttcatgcaggtccttttatgtttagttgaaattgtacttcctttgcagtctaccatgttcccccctttttttggcttaaaatatgaaatatgttttgcatgcattttattatttctctttgattctacttgttgatatttttcattcagaatttcaaagcatttatttttgcatttatatttacatatcaaaaatatcatattttaatagttttacatattaaaactattttcagttctggtctacttggcttttacagtcagctttatgaattgaagctttggttcttatgggtaggtaatggagataatattattgtgtgttcccagctttctccttttccacataccctgcctgctaaacaaaaatttgtctttgctcactccacttttctccacctccatcctctaaggattcttctgactttttcagttgttcttatgctttgtgggatataggaaaggaagaagtggataggagggagagagagtatgagtgggagagcactgatggtgatgaaatgtgaaactcgtgagaatcgaaaaagagagaaaaggcttttttgggggagaagtgtggatgtgcagcataaattggatcacctttagattttccttggaggtctaagtgaagatgaaacaggattttcaattgctattagttgctgggccttttctttgaatatactaccatgctgagactaagccacactggcttattatttgagttacttctaaatgttaacttactaaatgatatatttttgtgtatgcttacacaaataagagaactgccattacccacccctctcccaacactgatcagttgacctaagtcctctcgtctccctctgaaatctccctttcatcagtctgcttctttccatggccactgctgccatcctagttcatctttcacctggagagtagcctccgttgaaggcatccctgccttcaatataattccctttctcaactgcccactctgctacagagttaactttctaaaatgtttagactcctttgacctcctttgcatggcttagggaccacctatattttggctcttgtacctttgtagtctcatctcctttgctcccccatcaccactcaacccttagccacacaaaatgacttgcagtaccccacataccgaacactcctatgctcccataactttgcacatgctgttcccctttgcagagaatgcccttcccttcttgtccacttactccgtctttcagcccattgaagacccatttcagatgttacctccaccatgatgccttctgcttaatactttcaggtgactggcaattccctctccttttggagcattttcataaacccttattactcttctctgtgtcctccactgagcaggagtgagtggagattttgtggcagttcagggcatagtggttaagcttgtggcctctgaggctaggcatcttgtgttcccagctgtctcattctcttactttgagactgtgtgtagattacttaacctcccaaatcttgaattctataaaatgagaatcacagtattacctactttattggtgttttgtgaggagtaaatgagataagagtataaaagtacttaatacaatgcctgacccattataagtacttaatcagtgttggctattttatttagctttgaattctcagagcttagcacaacgcctgacacatggaagacaacttggcaatatatacggagctacaatattattaagtctttcctaatggcttttagcttttatctccaatgcattatcattatttggaggtaccatactctgttttgcagttatttgcatatagtcttattccccttacttgactgtgtactctttgtagctggagagattgtcttattgagtgttgtatccacagcacagagctttgaacttagcaggtattctgtggctggtttggtttgtattattttccattagtaatggaagtacccattttgtgaccttggttggtgatgcacttgtgggaaataaataacatactttgggatcattaaaatcccattaaaatcatccaatgtactgggaggtccaatttattgggtaattactagaattatagaacaaattctttggactggaggagaacataaagggcatcatatccaagcatctttcttctgactcttttgcatggaatccagcttttaaaaaatattgcaaaatgatggcatgaaggagtgtttttgccttggttctcatattattcctgctaattttacacacacacacacacacacacacacacacacacacacacacacacgttgagtataccaaatctgaaaactttttgagtgctgacatgatgccacaagtggaaaattccacacctgccctcatgtgatgggtcacagtcaaaacacaagtgcacaacacagtttattcagcatcccaagggaagaaaaagcccttccaacccccttcacctacagtatagattctttgcacatgtccagattcccccaaacaagcatgcctacaaagtgtaataaaatggcacatgtgcaggctggatatgccaacggcacgttccccacaattccccgtgtaggaccaagaccttcgtgcattactcattgtgtatttttgcttattctctgctctgtggtgtaaagatattgttgaaaatgtcaaataggtctgaagatagccctatgggtaagaggaaggatttatgtgtatccatagcatagaaagtcaagctgtgggagaaactggacagcagtgtaactgtgaagcatcttacaggagagtatggtgttggagtgaccactatatatgacctgaagaaacagaatgataaacagttgaagttctatacaaaagtgatgtatagaggttattaatgaaaaatagaaaaacagtgcataaagctaaaaatgaaggtctcaaacatgtattgaaagagtgagtccatcagtatcacagtgaacacgtgccatttaatggtatgctgattatgaaacaagcaaagaaatggcaaaaattttgccattgctttcaatggcaaaaactgtaattatttttgcaccaacctataatagctgaaatggttctaaatcaaggtgatgatgaagatgacattgctaactgtaaaaaaaagtgcctatagatgatgtggtgaaattgtgatgggattattggatgactagagccatatgcatccataacagaacaagaaatcatgtcagttgataaaatcaggggcacttataagacaaaaacctctattaatgaggctgataactctggaggaaacatttaagaaagccatccagcagaatgcctcctcatctctagaggacctacttcctggtccctcaacttcttctgatgtttcttctcacctaaaaaaatagagtgtataaattagctgggcatggtggcacgtacctgtaatcccagctactcaggagactgaggcaggggaattgcttgaacctggaggtggaggttgcagtgagccgagatcgcaccactgctgcactccagcctgggcgacagagcgacactctgtctcaaaaaaaaaaaaaaaaagaaagaaaggaaaagaaatacctgagactaggtaatttataaagaggtttagttggttcatggttctgcaggctgtacaggaagcatggcacatctgcttctaaggaggcctcaggaagcttccaatcatggtagaaggcaaagggggagtgaggcacttcacatggctggagcaggaagaaaaggagtggggaggtgccacacacctttaaacaaccagatctcatgagaactcactatagtgaggacagtaccgagggggaaatccacccccttgatccaatcacctcccatcaggacccacctccaacattgggaattacaatttgacatgaaatttgggtgggtacacagatccaaaccatatcacatgtgaataagtgtaagaaaattattgcttatccaaagcatataaattcagtcaggaatgatgattatgccaaataaccacagattgtccatatgagtggctgagatagtgacacctttgctttctgatggttcaatgtacacaactttgtttcatgtgcaaaatcattaaaaatagtacataaaattatctttaggctatgtgtataaggtgtgtatgaaacataaatgaatttcttatttagacttgtgtcccatccccaggatatctcattatgtatatgcaaatatcccaaaatctgaaaaacatctgaaacactctgttctcaagaatttcggatatggggtaccgaacctacatatgtacatacatatgtgtttctgtgtgtgtgtgtgtatgtgataaatgaaaaatattataaaagataaaggaacaatcatatatgtatatatatacacacaaaaaaacacacatatatataattttttatatggtaggtgtttttcttttgtatttttcatattgaatgtcagttttcttgattcagtttataaaactccatgattagcaatgtgatttctgcaggatagggtgaccccctttcttctagtcctagtatcatttttccaggaagtctgattttaaacagtggtttggaatctcttctcttagtaatatcaagtgttttttaattgcttgcgcaatagactccataaggatgtgaagactattttagatatggttttgacagtattttcaagcttccagctttgcatcctacactgatttatatattattcagtatttttatacattcattttctctccaaagctgttatatatacataattttcttaattctttaaatagtgctgtggttatcactgtggttagcaagtgttgattttctaatttttgctgaaaggttaatcagtgaacaaagagcttaagtggtttgtaccagtgatgtagttaattagtgataaagctacgtgaacattctagcattctagccacttccctttccattttcatgcatcataaaatcatgtcttatgcagacaagtaaaactaaattttatgaatgcttatattgcccatacaggtgcattttatcttaaaccatagatttagtcatgaaaacttgagtatcgattataaataggtttatgatatttttgtaatacaaaaaaattctttggaagtcatccctctgtaatttatcttttttgttattcatttatgcaacttacctttattgaccatctcttatgttcaacatgctaaatgagattcaggtttgtataacttgagttttcttaaaataagatacgcctatataaacacagtatccataggaacataaatttatcaaaaaatgaagtgagaggaaaaaaataagaatttggagtgagattataacttgagcattggtatttagatgtacccccacctccacaatcccaattgaaatcactgcaaaattttaaaatgtggagaaactaaattcatgctggaggccagggaggtgttccaccttcatgttgcaaactttgaagagtttccacctgatatagtgcagatgggatgatactgaaagaatatacccaaacgaacttgcaatttcacttcccgagaaagtgacaagaatcgagttgggggttaggacaacctgtaggggtttccacatggtttactttcacaactattgatggcttaagagtgtcactaggagacccagaaatatagtcacactgaagtcaaagcaggccctgcattcgggcttttctctgatggaacaggcaacggcatacaaaggactggccactcttcctggagtggaggttgggtcaactcataaaatgtttatatggaaaattagaagtttttcctgctggggactacccatggttccagctcccttcctacttctcttgaccactctacatgaatttatattaaccagagaggaggtatctaagaacattaggatagatggtgaagggagtgaaagaaaacccacccacccaccctattttgtggaaaacaccagcctagatagactgctctttgttcaggaatgaacaaagaaacttaaggtttctgaaaagattctacaacataaatggagaacatagtattcaagaggcagaggaagaaaaatacttattttaaaagtatgttttctacagaaaaaaataagtatttttgataacaatgtgctttgtgtaaggaagtatataatacaaagtgagaagtaaaagcaaattaaaaatattattgaatgagactgcaggcaaaaagtcaaagggagattgctgaagaaggatgaaatgtgaggaatctaaaaatgcattatatgtagtaaagaaaagtattaaaactggggagaatgggatgagtgatggaaaaggtaaacttgagaaattctcctgaaatgcaatggaaaaagataacagagcaatgagatgatggcaggttggacagaggattgagctctaacatgcagacaattgttcctaaagaattaaagtctagattaaaagcaaccaaattgattaagcataccataagaaaacaatacaaacaaaagcaactttctggattacagaaagacgtagaccgggccgggtgccgaggctcacgcctgtaatcccagcactttgggaggccgaggcgggcggatcacgaggtcaggagttcgagaccagcctggccaacatggtgaaaccccatctctacaaaaaatacaaaaaattagctgggtgtagtggtgggtgcctgtaatcccagctattcgggaggctgaggcaggagaatcgcttgaacctggaaggtggaggttgcagtgagccgagattgcgccattgcactccagccctggcgacagagtgagtctctgtctcaaaaaaaaaaaaaaaaaaaaaagaaagaaaagaaagatgtagaccggcagataaaatacttattctgtaccagagaaaataaaaaagagatcaataattagatctaccctgacaaattttcaaggataaagcaaggaaattaccaagcatcaggatagaaaaagtaatttaaccctcaaaggcaaagttgacattggaattctcagcaatactaaatgccagaagacaatgaagccatgtctataacttttaggggaaaatgtgactcagaaaatctaaactcagccaaggtgttatcattagtgaaaacagcagtaagatctcagttatataatttatcactaatatgctatccacatacttttcctgaaaaagttgcttaattgctagtcaattaagagataaagcaaattaaacagttcaaccatggggaggtcatgaaataaaatgattagtggtgagtagtagaaagaaacatatataataggtcgtgaaatataaataaaattcaaaacataacataaacattttgagtatttattgaaagataaaagaataacaatcataaaatgagccccaaatccaagatagggatagaaaaaaaatatgaattatttagaagaatatgcaatttaacaggctatatggtcacaactatgtcaaggaaagacatcaacaacagtggggttctaggtaatagaaatgccatatactttttcctgctactctctatttccatatttttgtaatacgtttgtatttttatagtgtgtaaactttatcaaattaaatctatgtatacagcagagttataattacagacacatttgtagtattgactgctttgttattgctctccaaattaaaaataaactaagcatttagcttaagacattaaaaaatacacaataaaacagacatcagagaacaaaaagaaaaataaatttcaaagcacaattttttgtatcagtaaacaatagttttgaaaaagcacatgccgtctgagttgagtatttaaaacaaacagaattaaacctaaacaaaaaatacagaaaacaatgtatttaaatcataaactcagagaaagtaaaatgtatagctatgctaactatgaagtgaatagtattaattagcaaaattgacttaagtacaatgctggaattggccaatatatggaaatattagagaaaactgccaaagagctactccaaatgttagtgattgtctctaagtgggtagcattatgggctattttactccctctttgtgtgtttttttttttaatttttactttttacttttttccccactacaagctactttaattctttgaacaatttttccatgcgggtaaactgttaccatattttcctattaagaaatattttcaatagattttttttctacaataaattttactggaaacatttggttcattaatttttgtctatatgaatgctgtccatcatggcttttgacaatctgagttttttttgatgatcacatttctaccaaaatcaattttcctaagtcaaattttgtatatccagattttgtaaatatttgactcttctattgatttttaaaaaatcaattttaccatgtgcatttttccttctgttgcttttattttgtttgggtttttaaaaaatcacgtttatttttttgcttgtctcaaaaatttttaataagcaggtatgaattttgaagttagatatgaataaaaaccaactgaaaaagcaaatccctctgtctcccaagacaaagtgggcagtttgtttcttttgagctttaaaggtagaaatagctgcctttctaaaatttaagtgaagcgaaatgttgacatgccctgaaaggactgccaaggttcagggagcctgttaatgggccttgagaggctctgtgactctggactaatggcccagggaccactaagagtaaattgaatttctagattactggctactttcacagctctctgatgcctccaggatgggagagtagacacaccaaatgccagaaaaataaatgctaaataataattcttcgaggttcaatggaatatctatcacttaagtagcaaactatttactaagtgtcccaaattttgcacatttgcattgcaagattttactagtaacatgagtaagtgaactgttctttacctcactcatggaataagtaaatgaaggttgtgctttttgatttaggccactcttgatatactacactcagaactacattgctcactccccttcctaaagaaataaaggtgaattgcaacaaggttctctcctgcatgttagaaacactgcagagtataatacttgcatttgccacacagaaatgcagggagagaggagcaggttggaaaagtagttttctcatctaaaattaaaaaaaatttttttgatagaaaaattttttttgaaaggaaaactcattgtgtgtatatcttgcttaccttgttgagtgtatacttacattttttatttaaaaaatttttttttagaaacgaggtttcactatgttgcctaggctagtttcaaactcctgggctcaagtgatccactcacttcggcctcccaaagtgctgggattacaggcgtgagccactgcgcccggcctatttttcattaaaaaacttttttttttttttttttttttttttttagagatgggagtttcactctgttgccaggctggagtgcagtggtgtgattatagctcactgcagcctgagactcctggattcaagtgatcctcccacctcagcctcccaagtagctggaattacaggtgtgtgccaccacacccggctgttgttttgttgtttttattttttttttgtagagacgaggtttcactatgttgcccaggctggtcttgaattcctgggctcaagtgatccgctcgcctcggcctcccaaagtgctggaatgacaggcgtgagccaccatgcccggccgatttttaaatttttttaaatagaattcctataatatacaaatataatacacaaatcacctacctcacttttaaaattctacatttttttaaagacaagtaggagggtgactttattcaccaagcgatcaaaagcaggctgcagaggacagggatttagattgggaaactctttgtattctatcaagctgtcttctttactggctaccttaaggcatttttgctgggaagaaaaaccttaataacatcaagggcagtttaccttaaccctcctgccatcccattgtaccccaccctaccagccagaaacagaagtcttacgaaaaggttttgaggaaaatatcctgtcctagtttactccgttccaacgaattcttcaaacacatccttgacccaggacatacgcagagttcaaatctagtctgtatgttttgttaggctaccggtctcctttcttgggaagactcctgactgtgccttttctgtttaaagatggtagaggcgatgggtgttctcccgcaagacggtcaaggtgtgggagagcgacacacctttgattctggcaatctctcgcacagtatgcagggccaggcctgggtgggcatactggcaatagcttttgggaacccagcgagggaggaagaagggagcatcggtttctacaataattctctctagcgggatctttctcacagtttctcgggcttgcccagcagaagagtaagtcagaattgccgtgaagcccacatacaggttgggaaagtggttcaacaggggctcgatgactgagtaactcccagtgaagcaatggcgatgtatcttgtggtcagagggcacgtaatttttcaagatgtgcagtaggtcttcatcggcttctcggcagtggatcatcatgggcttctttagagagacggccagccgcagcagtctcttaaatactttctgctgctctgggatatgcgtggtgcacttactggagtaatccaagcccatttcgccgaatgccacagccttggggtgtcgtaaggcttttaaaatacttctttcttgatagttgttataataatgggcaaaatgagggcgacagccaaagaccccccaaaccagatcatctttcaactgatcctcccacaggttatcacttaggttttgaggattgcagaagcaagaaatgcagccctgaaactccttggggaaggtgttgctataaatttttctgaatttggtaaaggtgcctttgaaaggcagcctggaatatagcaagtctaaatgacagtgggtatcaatgaaacccggttgctctggctgccagatggtccttggcggaaagctagatgcacgtcctccataaggatgtcctaatgtctcctcttgatatactctctcctccttcgcctctgcttccacatttctggagtagtaaaataaggaagaattcttggatctgccttcctctgtcatcttcagatctctggatgtgttttcggagctcactggaaaactggtggaataatcactcaggaagctctggtggctgctcctctcaccctggaatatgttgttgttgcttctgctgctgctgctacagctgctcttcccagcctgcaatgtgttactgctgctgcccaaggagggatagcaagaagacttggtactgctgaaccaagagctggtgtagtcatgccaaggactataatgaggtggaaaagtggtgtagtcagtggcgtagtatggaggctctgacactacaggaagacacagtgagaatggcttctcttcagagaatatgactgtggttccacctacatcagaccagtcactccctgaagaggggcgctcaattgccatcttttctttgtgcttttgaattactgaatgggagttatagttatccggaacatttaaaggtggagagcttttttcacaaatgactctactttggttgctaagtcgcttttggattattacatgggggttatagtcatccagaaaatttgaaggctgagagcatttttcacaaatgagtgtattttgtgttttaggtcgcccctcactgaatttctcaggaggattaacagtcaccctcttgtcacaggagctgctcatttctggggctgactctttctctttttgaggagcaaagatagtggcattcctggctggtctttctccacagtagggacactctcctaggtctgattgtgaactaatgacagcctcttcctttacttttggaatgtcatctcccaggatctcctggagaacactcagagacaatgaagagccactatcttgaggtctacccttcctgctctggaacttgtttggttcctcagtttcattttgaccctcacttccagctgtaaattgagggttcatggaattataggagctacgtttggaattaattttaaggctgtagataccctcctccagagaagccatttctttaaaaacggggctggcagagtgcactggggatcacaaggacgaaaggaactccaaatgctccaaatgaggcagtctttggagccggccctaatcaggccagtggctgaggaatgggaggagaaggaggagaaagaatttctgtggcaggatgaaccttgagaaaaacacggtgtgcaggccacaaagtagcctttaggcctttcaggcctttggggcctctctccccttccaaaccacgttactgagctccgcggggcacctgtgtttgctgcaaaccacgttactgagctctgcggggcacctgtgtttgctgggggatcctacctaagtgccgctccggtggtacttttctgcgtgccgacgggccccagagctggagggccctcacgccactccggcgcctccttttttcaactgtctatcacagttctcggtgttctagagatgccaaagcccttccacaattatttcaaagtgctctggagaagtcctaaggatccaggcctggtatggcgtccgagcccggaacgtactcctaagactgtcccaaatggtctgattttgcgctgtgcaacttcccggatgtaaaaaaaaaaaaaaaaaaaaggtacttccgtggagtcaaagtgtttccggggagtcaaagtggcctggtatggcgtccgagcccggaacgcactcctaagactgtcccaaatggtctgattttgcgctgtgcaacttcccggatgtaaaaaaaaaaaaaaaaaggtacttccgtggagtcaaagtgcttccggggagtcaaagtgcttccgatcggccgtgcgccgtggcttacgcctgtaatcccagcactttgggaggccgaggtgggcggatcacgaggtcaggagatagagaccatcctggctaacacggtgaaaccccgtctctactaaaaatacaaaaaattagctgggtgtggtggcgggcacctgtagtcccagctactcgggaggctgagccaggagaatggcgtgaacctgggaggcagagcttgcagtgagctgagatcgtaccactgcactccagcctgggggacagagccagactctgtctcaaaaacaaacaaagtgcttccgatcaaaactcttacttttggtttggaatacaaggccctttggagatgtcagagtccatgaaatgactacaagacaccttagggatcagacacagggtgcccctgggtgggcttctggcctagatgccctgatccccaacggccagctggaggacagggcagaacatactgtagaagccgagtcgggaagcctgcccagcccccatcacctcgcctgccagcctgggtcaggccagcagcccgctccatctaagagcaacactcacctccccacggccatccagcccctcctttaccacgcctcttctcactgcccagccacgtgtctacccgagctgcagccattacatgctttttgttcctcccctccaccctcagtttcttccaaaagcgtagtcatggtttttagagcatagtttaaaaacatagttttaaaaaacatagttatgactgtggtatataacaattttcagtcttgtggtgttttttttttgtttttgtttttttctttgtcctcctctcccacccccccacccccccccaccccccccccccccccgccccgagagggagtctcactctgtcgcccaggctggattgcagtagtgcgatctcggctcgttgcaacctccacctcctgggttcaagtgattctcctgcctgtgcctcccaagtagctgggactacaggctcgtgccaccatgccaggctaaattttgtatttttttttttttttttagtagagacggggtttcaccatgttggccaggctggtctccaactcctaatctcaggtgttccacctgcctcggcctcccaaagtgctgggattacaggtgtgagccaccgtgcccggcccagtcctgtgttttagtcacttaacattactgtatagcctcagtatttttcttattgcctcatgtttttcaaaaatatcatgctggtgcctttataatactccatggagaacgtagatgtgccgtaattcaccaagcccttccctttttgttaacttttcaggtccccttattctacctttttttttctatgataaaaagctgcaaagaacatctttgcacatacaagtttcttctgtattttgggttgtttctttggactacgtgcggggaaatggagttcctgagaggaggtaggaattttaaattggttcctcataacattacattgccgcagaaaattgtactaacttaaaatctcatccgtaatgagtggtccatttaataggagaaacacacacataaaccctatgcctcgttgttattttaatttgcacttaatctgacagtttcttagagtgaacttctttttatttgttgaccctctcatgaattttgtttatgctgttttcccatttctcttttagggtctttaaaaaattaaacatttttataaaattaaagtttagccatattttctaaaatgttttgttagcatgtttttgtttatattttagtatatcggagttataacttatgtagttaaatcttaatttttaaaaatgttttctttctctttttctcccaagcctgcaatgtcattcctccttctgaggcttgacacatatttatttttttggaaggtgaaaggaattgatttattatatttaagccaatacttcatctgatatttgggttggattttacaggaaggaggctatacactgatgcttttccaagttggtactttttttgcttattgatatgtgactcctctttcattatgtgttaaattcctgttaacagagtctatttccagggcatctgttcttttacacctactatgtctcttgttactgtggtattgtactactttaataaatgaactattatattaaggtataaagtctgggagagctagatttccttcattacacttaaattttacaactatctttaataggctgaactatttatcaggtagacttaaaaaaataattctaggccaggcccggtggctcacgcctgtaatcccagcactttgggaggctgaggcgggtggatcacctgaggtcaggagtttgagaccagcctggccaacatggtgaaactctgtctctactaaaaatacaaaaattagccaggcgtggaggtgtgcccctgtagtcccagctactcgggaggctgaggcaggagaatcacttgaacccgggaggcagaggttgcagtgagtccagatcacaccactgcactccagcctgggtgacagagtgagacttcatctaaaaaaaaaataataattctaagtccctccagaatgacattgaaatacccacttgaaaagttattttagtctgcttatccagaatatacttcgcctatccttttagtcaagctcttctattaatatatcttctagtaaatatttttagagttttatctgggtcacagagtttttattaaaactatttttaagtattttgtaattttgtattatgaacatactttccccccattgtatggtctagctggttattgctaacacataagaatattttaaattcaggtatggttgtactgaaatctttgttagtttttcagcctttgcctaggtcattattttatctacccataatgataatttttgtctctttcttgctaatatttttacttcatatctttctacgttgtccagagcttttaaaaacaatattaaataatgatgctagtaggggcattattgttctattcctgattttggtaggcacatagtttaattaagtattatgttagatatttaggctgttgttttaaagcagatctttttgtaatcttgttaaggaactacccttgcatttaaaaatgtatgtggtaggaaatggtgtgagatcattatatatttgctcatatttcctaattgggaaacatgttggcatctgtgagtaaaatgctgttttttttttgtgtaggtggcttgtaactgttacagactattaaattctgtttgcttgtattttacttaggatcttctgtaaatcataagtagtgaaattgttctgtagcagtagttctcaaccttggcttgcagtttgtaatcacttggggagctttaaaaattactgatgcctaggcccaccctgagagaatctgatttctgtgtgtgtgtgtgtgtgtgtgtgtgtgtgtgtgtgtatgggggatggtggatgtctgtggcgggggttggggggctggtggtggacagtgtggccaatgcatcaggatttttaaaagctctataggtgattctaatgtgtagccagggtgagaactattgttttacagttacttttttttcatggtacgtctattaggcataggaattcacctttgtagctttccatcatttttggtatcctggagagttatataatttggtaattttcttttccttgaaagttggaacaaattcattagtaaatcatcctggttggagactttattggggcaattctttggtaatttttttcactgcttacttggttattagcttattcattgtgtttttgataagtcacggttcttacagaatatcacttatttaattgcaattttaaaattcattttcatatgtttgcatgattattataagataatttatcttatggtttatatcttataattgcatctctgtcatgcactgtatcatttctcattttatttatatttttcttgatgagctttctaaaatcttatctattttatttatttaaaaagtccttggatttatttattgcagttgtttttcttctttcaaatttatatatccttactatcttttttgctttctgtttttcttatgacaaatttttgctttttcaaaaccttttgtttattgttttgaggcagtctcattctttcgcccaggctggagtgcagtggcacgatcatggctcactgcaacctctgcctcctgtgttcaagcaattctcctgcctcagcctcctgagtagctgggattacaggcatgcaccaccaggcccagctaatttttttgtatttttagtagagacggggtttcaccatgttggccaggctggacttgaactcctgacctcaggtgatctgcccgccttggccttccaaagtgctgggattacaggcgtgagctactgcgcccggccttaaaagcttttgtttgaatcattgctcactggttctaaactctggctatgtttcagaattacctggggagagtaggaaagaaaaagaaggatcttgtacttgcctatctcaaagttcatggctgagacctctataacaaaagacagattaacaagagaaaagcacacaaatttatttaatgaaagcttcaggagacatggagccttcagaaatgatccaaagaaacaggaaaaactatttttatggacagtcatgtagaactgtgactggaggacaaaaggatatgatctaatggtaataaactggggggaacttataatagcaagatttgtttgttccgatttttattcttcatccttatgtgacactcctttcctctgggtatagggcaggacacctgtcacatgcgagtctatagggaaggaggaagggagaaggtcagagaatgaccttcctaggtgttatgacctgcctccggggagaatgatggaagaaggtcagagagaccttcctgcttctgcctttttctcaaatgccaaggtgccatgtgcctcggcatatttgccgaggtagcatgtcctgaaccccatcagtagcttttaaaaaatagtaatagtcccctccccaaggttctgatttaacttacttaggcaagggtctgggttttttgtttgtttgtttttcacggaatgtcactctgtcgttgctcaggctggagtgcagtggcgtaatcttggctcactgcaacctccacctcccaggctcaagtgattctcctgcctcagcctcctgagtagctgggattacaggtgtccaccaccgtgcctggctattttttgtgtttttagtagagattgggttttgccatgttggccaggctggtctccaactcctgacctcaggttatccactcaccttggcctcccaaagtgttgggattacaggtgtgagccattgcgcccggccagatctggtctttcaaattttttttaaagttcccaatgcatagccaaggctgagaaacactgttagcaatttatcctctctctcagactctaaattcttttatgtaataattttaatccattaatttaccccagattgcaaatttgcctatatcctataggtttgtatggccttatattttattatatacttttatataaatttattacatacatgtatataaattttatttgtatattttttatatttttagatttatttttggtacaattatgaggagtgacaattttcgtttataggtacattatacacttctagttgtattactttgtgatcagtgaatataacttgtataatttttctgtttttaaaatttattaaaatttttgtgaattagcatatgtttcagatatatttctgtaaatatatatattgtcatgtataaaggagccatcctctatatgcaacacaaaatgtattatcgtttatttccttgattatgggacttcataatcatgagagaaaccattgatttaataacagctttttcaggaagaataaacaacactgtattaaatgtacacaaatttttcttgtctactaacatatagagcatgcatttatccttaccattatatcccttttatagtacttcacaatttaagtctgaacctttttcataaaacagagcttaaacatattaaacttggacatgtgatgttgacctctttataaaatgttgaggttattgaacattgccgatgttttgtctttctttcctgacagcttctctagaaattcagctgtaagatttttttttttttttttttttttgagctggagtctcgctctgtcgcccaggctggagtgcagtggcgcaatctctgctcactgcaagctctgcctcccaggttcatgccattctcctgcctcaccctcccgagtagctgggactacgggcacccgcccccacacctggctaattttttgtatttttagtagagacagcgtttcaccgtgttagccaggatggtctcgatctcctgacctcgtgatccgcccgcctcggcctccgaaatgctgggattataggcgtgagtcaccgtgcccggcctcagctgtaagtttttgacattagatgtttgattcctgaagtgatagtctttctgactcacgtattggccacatcagcctccccatctttaaaaattatatgctttattctaagaaattaggcttttgcctttgccttacagttgcatggtctagcctgcaatggacaaccttctccacgcaattattttttgtgtcatactgcatcagacaataatcattttcaaacattttaagtgaaaattaagaatctaatgttaaaatccagctgtttgggatatgcaatgctaagcaaataactcaactgtcatgaagataggatagattcttctctacaaagctaaatttgcaccatatatcaagttagaactacttcccatcaaaatgcattcttgactgctttgagattcttttggctttaattgtaagaagatcctgaattcagaaacattaacatttaaaatttttcctttgtaatgaggaaatcatatacctgttatttaaagctaattgatttcagatttcaggagttttttctttttcttttttattttcttttctgtttttctgtcacccaagctggaatgcagtggcatgatcatagcccagtgcagccttaaattcctgggctaaagcaatcctcctgcctcagcttcctgagcagcttggactatgaggcacgcaccaccatacctgactagttaaataaagaaaaattgttggagagacagggacccatgtgtcacccaggctggtctagaactcttggcctaaagtgtttcaatcctcctgatgtagcctcctaacgtgttgggattacaggcatgatccactgtgcctggtctaaggttttatatcctctaggctaagattaaaattccaaatgccttgaggatcaggtaggtaacctcatataatatcatagggcctgcagagccagagaggcctgtggaggactgaagatcacatgcccccaccaaatgatatttatattccgttttcaagaaaattgcagccaattacatcctctaggaccttatttttcttttttcttttttttttttttgagatggcgtctcactctatcacccaggctggagtgcagtggcaccatctcggctcactgcaacctccacctcccgggttcaagcgattctcctgcctcagcctcttgagtagctgggattacaagcatgtgccagcacgcacggctaatttttgtatttttagtagagacggggtttctccatattggtcaggctggtctcgaacccctgacctcaagtgatccacctgcgtcggcttcccaaagtgctgggattacaggtgtgagccatcatgcccggcctaggaccttatttatctagtttctgcttgacatcataaatgatgataacaccttacatcataattatgttcctataaattttcatttttaacagtttttattttaggttctgttttctggattctctgatacatcaagttccattgcaattagatcatttatttttgtgagatcactttttaatctatttggtgtctctcctcttacattctacttcaccacattttataatttcctcttcctcttccttttttatctttccatctctacctcattctgacttgctctgtatctttcatgctggagtttgacagccctgtattctcatgggagcagactatgaaatatcagtctgtccctcatctagacatattgaagcccaacctaagataatgtctttccttttctctttatttcaatttagcatccttctcttttaatgcatcatttgattgataaatatttaatgattacatacatgacagttgacctatgccagttgtcaattgacctatgccagtgtagtcattctcaaatttatactggcagcattcagtatatagaggtgggtgacagccaagaatattctctctacactttcctacttgattacaaagaaaaaaaaatctcagattaaatattacgtacactgaaagtttgatgaagccccagctctttctccttttaggtgttccaacatctttttttcctcctccttttttaaaaaaaattatttttgagacacagagtctcgttctctcacccaggctggagtgcagtggcgaggtcataactcactgcagcctcgatctcctgggctcaagcaatcctcccacctcagcctccctagtagctgagactacaagtacacgtaaccaagcccgactaatttttaaatttttttttgtaaaaacggggtctcattatgttgcccaggctggtctcaaactcctgggctcaagtgatcttcctgccacaggcctgagccactgtagccagctccctccccctactttttaaaagttgaaatataattcacataacaaaaactcaccattttaaagtgtccaacacaactcagtgtctaatatctttttttaactgaggtaaaattcacataacatgaaattaaccattagccattttaaagtgtgcaattcagtgacatttaacatatccacaaggctgtgcaaccatcacatctatctagttccaagacttttttgtcaccccagaaggaaactctatacttgtccaacagcatcttatctgaaatattcactcaatacaaatgtgacagcattctagcaatggggtttagctaacctaattggagtcaggccagacaaattctttaagaaagcagctgaacataggactatttgggaatgaagccaaaggtgccatcctgaagggagtagatctctgggttcaccagactcttataacctgttcctgtaaggacagtgcctggttagtatttgtaactgatatgtgcattttgaatacaatcatttcactaaaatttattctaatatcatttatggcaattgacaaagcttcttgtgttgatcaaagaaaaagctactgaggcattctgttagccacttctgaagtgtgggcttctgataaaaatatgctaaacactcctggagtatatattcttacttaggttaactgaccaccacccctagagggtagattgcatctaacagactcactcatatatatcatattgtccacattgaataaccctggagttacatcatatgcacagttaagttttgcaacttcaattataaaaattgatcaaaagtgagagacaaagagaatatttaaatggagctctcacagagcttgagccgcaggtcaagcttgaaatggtagcctgaatctacttttcccacagttgtcctcaattaccttgtcgtgctcagtgtgtgagcaggatgccatattaagaatgtttccaatggctaaagatatatattattcatacaacatggcacctaagcataaagaaatgattttaactggtcttcaactgaagaagcaggcagtcatctgcttcaatatgggagaaaaatgggctgtgttttacttactgagaggcacagttttctaaagtagttaaggaattttcaaagatatttttgactatctctgaattttaccataactgctttagaatccacctgtccttcccttccttattccctaccgcccccatacaagatgagtctgagtctagcattgggctaggctccttgaggttcccgaagtgtaaggtggggtctccagggcattggatgaatttcagatatgcctgcttgaattgcctgaaggcaagcaatcatcaggactaacagtcaggataattttatgccagaaccaaggcagctttgtgttattgttaatgggaaaaaaatgacaaaacttattcatcttgtgagaaagaatattttgtctctataacatatacatttagaatcccactgtgaaatcccaaaggcagactctagttcagtttatggtagagctgaacgatggatgtattacttgaatatcatttccttgttttaaccagatggtgataaaagtattaaataatctttatgtattgtatcttagattgtatatccattcgcatggctgatgtgtagaatgagttcttggaaaaattctctctacttttttctttatattaacaaaaagtatacaggcagctgctttgttaattttaagtttgctgaattttcttttcatttcttagtttctaattattattccaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaaggtatctatttaaagcagagttatggttccttcacttctgactcctgcctttatatactgcctgcctttagcttttcaaaagactgcatgctactgtttaggctgtctaacctgctggcagtggtgaatataaacatgccattagcgtgtagttattgattgtgacttaccagctttctaccctctgcatgtcaacattggctgggtctctcactcctccgtggcatacttgtatcctttcaggtgctgctctggtatgagtaaactctcctgtgcctttgactttttcctcaaaccctttggtcgccttgccgtgagcagatcacttccttcacaacaccattaggggagaagagaaagctgttctctactgcagcttccagattggcattctcttctttcttgaatttactgtcatttgtttcaaccaccccctcctcatcctcatacctgttaactacagacttcgatggtacctcaccagagagtcattgttccttcaccctgtgtatgccagtcatctttgtccatactcctctcagccacagataagagttaactctgtgatgtggccaccagagaagctaatcctaggttgcattaagtatggcagagatcaatggagatgactgatttcttctgtttgtgctgtgggtccttctcttgggatgctgcggagttctgaatgacttcaggggacagcaactatgacggtgaaagaactgaacatttgtcatgtgcaagacagaatagtgaaaagggatatttgtctgtaatggggagactccagtgtgcttgataaatgtcctcaggaatctaaagggctgtcatgtggagaaggggtgaccttattctctttatgttcatggatgggacctaggggtcagagttcaggtcagtaagaggaagaactttctggcagagagctgctagaagttatagggaatggacctgggtagggttggggttaggggtctggtgtaggggcggaggagaggagagtcacagatttgtttgttccctcgtgtagatagatggccctgggggcaggtcaggggtggtttttcactgacagcctgctggaagtatgagaggatttgagtgtttgtttggttgctggtgtaaatgacctttcagggtactcagttccttgacgagctgattcttgggtgtgttgttgtttctttgccttttagagtattgccacctccagtatctcagtctctgaaattgtcttctctaactacaatatatactccttttactttccctacttgctcataactaccatccctgttcttcactctcctagaaaaacatatcctgaatatgtccatgtctttccatccccttcactaccatcctcacctaagctaccctcatctgttgactagaggaatagaatagctgcctaacgtggtctccctgtttccattcttgctcctcctacaatctgttctgtatgcagcagggagagtgttgtgtgggatgttacctggatacagtggtggcctttgagaattgtacatgcaggctctcccagaggtcacaaaacagaaggctcatggatcacattaaaatgcatgaatcacatgttacattaaagtaatttaaaacacatgatgagaagaaagagggaaagagatagggtaggttcacacacttgggacagggtacaagtaggcagaaggaccatactgcctgaatcctggggtcagcaatggttctgtctctgtttcactaaccttccctgctactagtatggtttagagaccagaactgaggttcaagcaaggagaaccacagacagaaggggcttcgggctgagggcacacacttgctctgttggggagatgcagggagaagtgtgcctggccatggctgtagcttgtcaataagcctgctggatagtcttgggttttgtttgtgtttcttgggcagaggtcacatggggctagaatgggtgtcaccgatgaatgagtggccaaattgaggcctcataaatattgggtgctcatgaatatttagtgtccttatatatttagcatatcatgaatatttagagtccaggtgcctcatgtatatttacgacctactgaaaatcagttatcttttggtttttccatccctttctttctatgtttaacatgcccatgctctacttagcatacctacctacctattgttatttaacacatctcatgatttctgcctatgctgaacaaattttgcttactaattactaatctaggcctgagggctctgtattgatataccacaatgagttcaagggggagaagcagggatttgagggccatgggctctgagaataaggttgtcatgcaacctcattaagtgtgcagaggacttccttcaatgctcatgagattgaggtttttcttagagcatggcttcattgtgtctggtggttggaataatgaatttggagccagccagcattgccaagaagtatttgttggatgcctattctgtgtcaggcactgtgctatgttttgggaaaatggacaaaaggactgagtcccatcatagccctatctcatggagtaataataggccaccagattggaaaggaaagggagcaaggccaccagtccaagagttttgcaattgttcaggctagaaatgctgagtgtccaaaccaggacaatgatggtaggaatagaaaattggggaaggatttgagagacatttggttggcagagttgatatgcattggccagtgattaaatacagagagtgaggagggggaatatctaatgaaaaagtgcctaccttatcattatctcatttaatctcctgatgaccatctaaagtagttactgtcactgtcagcttttacagaaaaggaaacaggcttagggaggtaatttgctcagtctgttttgcattgctctaaaggaatacctggggctgggtaatttataaagaaaagaggattatgtggctcacagttctgcagactgtacaagaagcatggcaccagcttctgcatctggtgaggcctcaggaagcttttactcgtggtggaaggtgaaaggagagcaggcgtgtcacatggcaagacggggagcaagagagaaaggaggggatgccagactcttgttaacaatcagattttacggtaaccaacagaaagaactcacacattactgcgaagacaacacaaagacattcatgtgggatccacccccatgacccaaacacctcccagcaggccccatctccaacactggggatcacatttcagcatgagatttggaggggacaaatatccaaactatatcggcctcagaggtctctgtggttgagtcatgatacctttataaagcccaggagcacagagcaagaaacaggattggggtttgaatctggggtgtgtttcagggcatgaggcctttgaaggggtgttagacatctgtgtggtgatgcccctccaggcaggtacaaacttaggatgtgttttcaggaaaaaagtcaagactagaaatggagattgggaatcagaggtgcccagatcatgaccaggctattctaccatgttagaggagagccactggtgaggtgatggaaagataaagggaattcaatttagtgtctctgcttggttttactagtggtgggaaaagacgaagattagtatgaggaggtaatatgaactgtcctcattgttctttgtgttccaactgatacactatccactccctggccattttatttggtgaatttggcctaatggtaaatctttcaggaaatatggaaataccataacattttaaaaacaggttttcacaaattttaaggttaaaagtatgacattttattttacaaagggacaagaggttttagattctttagggtcatttaaaacatataaggcagtttttaaagattggcaagaatgcattagaaaatggttgaagattatttaagaacaaagaatttacaatttataatttttgtggacatctattttacttacgtgtatttgattatataatagtattgctgtggcaaaaagaaaaaatttcttacaggttttcacctaaacattttgttctgatattccctcactaagctctgcttattttctgattactttcccaccatgacaccaaacttgcacaaatgatagactggaggtcacaggacaccccaggcctgggttagtgacttgcattattgttttcattattacctttaaagtgaaagctcataatcctatagctcactggcccctgtccagttcatcttagttttattaaactatccaagaagaaatatgaaatgtagcttcttttagaatcttggaaaggcttttattaagacttctcaattctttcagactcttgatttcaaatctcacataggcagattccaaaggcaagctgaagatagtcataatgatgtacttgaaaatcattcttgtgtaaggagggaggaatgctatcataaagtctcagaaaaaaaagacctgagtaaaagacaactttaaagtctctggaaattttccgaatttttgattggctcactgtggtcaggacatttccctgtgtgaagacacagctcaagagttgtgtatagaatacacagtaatcacgctgcgtaatgacattgaatttgtcagcagagtagagaaatttggaaggctgtagcaaatcctgtagaaagcaaacatgaataaccactctgtcaccaagctttgtttagagagaaaccagtctcttgaaatatttaatatgataattcttgttaaggaaggtctatttggactgcagatagtttgaaaaatcatttaaatgccttcttcaagcttttctaaattaagtgattggaaaaaagaaaacacttaatgagccagtggttcagacgtcagtgggacagggtaggtagtgtttctttcagttgtgacttgagtggcccgggcttgctttccatgcatctgggccctgggaagaggcaaatggtcaagattaggtgctgtgcagtgatggcgttcctgtcacttccataggattttgatattttctagatgaacttggaggtcagatgcacttgtttcttgtgtgaccatttggaaattagtgcaactggaggaattataaccctcccctgctcccttttggttgcctctattatcatgtaattttttagggtggggggagtttggaatcagccagaaacaaaagaggcatccattagcatggtaccaaaataggcattcatgcagcttctaatcagaacaacatatttttaatattcacaagttcttgttggcaaggagatttgtgtgtgttatgagtcaagaaagccagtattgcacttcaaggcttgctttcatttcttgccaggacatcactctcttttcggttagatgtgttatatttacagaacgtgttgcttttctgctggaatgtagttaaaacaacattatatcaagccaagaatgtcagaggttaatccagtagttttacctctaattgtctaacagaataattgtcagttaaatacaccaagtccagcctaatctgtgctaaagaaaggataatgattagaaatgtgccgtgattttctggtatggtctataccagttgttctcagttgaaagtgatcctcagaatctcctagcccaccccagaattttttcttctgtagacatggggtcaagaactggcttccctatgattcttagtgcatcttggttgagaacactgatttccactaatgacttgttttggccccttaataaggtagtatttctcatatatatattttttaatactctaagataatctgcttgatcaggcaaatgtaatcacacaaaatagaagtcagtcattcatatgccattcactcttattgggcatgtactatatataggtattatatcccataaagtggtggaggggtggtgggaaggttgccagatgaagtataagatactcagttatatttgaatttcaggtaagcaatgaagtttttagtataattatgtcccaaatattgcataggacatagttatactaaagaatttggctgggcatggtggcttacacctgtaatcccagcactttgggaggcagaggcgggctgataacttgaggccgggagtttgagaccagcctgaccaacatagcaaaacctcgtcgactaaaaatataaaaattagctgggtgtggtggcacatgcctataatcctagctactcaggaggctaagacaggagaattgcttgaacctgggagacggaggttgcagtgagccgagatcacaccactgcactccagcctgggtgaaaaaaaattaaaaaaatttaaaaaaaaaaagaattctttgttgtttatctggaattcaaatttaactgagcagcctatattttaatttgctaaatctggtcaccctagagggtggacactggggagagaaccaggtacttgagggattagaggaggaaaagccaatatccactagagaatctggcatttgaatggtacctcaaaagtttctctagataaagatggaagagaaaggcagaatagtcaaaaggagcaacatgagataaagtggtgggacaataaattgggaagtatttgggagcagatcatagattgaatagggaaaacagggcaagaaggtggtcatgcaagaggacattaaagcatctgttattttggtgctttttcaatagctaagggggagatgcgtagggttactgtttcttattgtgagcagaaatgtggaatttttaacttcttattcttttgctgcaaggtgagtgcccggttgtgtatataaaaataattattcttgtgaaaccgaaactctaaaggtgacattttagaaaaataaaagtaaaagtatacaagtcattttagtagaggaatatagtaagcacaagaggaagaaaagacactctgttatgtgtgattgtggttaagcctcttagtatttttagggcacaaacttgtagatgtgatgataagtggcaattgcagttatatcttcatttacctaagaaatatctgcctttagacttggatgtactctaggcctgcagcattactaaaatgaaattaacatacttaaattaaaatagaggtgacccaggtgcagtggctcacgcctgtaatcccagcactttgtgaggccgaggcaaaaggattgcttaagtccaggagttcaagaccagcctgggcaacaaagcaaggctgtctctacaaaaaataaaaagttagccaggcgtggtggccatgcccgtaatctcagctacacgggaggttgaggtagggaggatcgcttgagcctgggaggttgaggctgcattgatccatgatcatgccactgcactgtagcctgggcaatgatgtgagaccctgtctcaaaaataaataaataaataaaaaataaaatagaggtgagagtttggagtcttaattctggaaggtgaattccagaaaagtaaatttagtggtatgagcaaagatctaaggcaagtctcaactgaataacatgaaaacacatgaaacataaatggatatatggtcactttgatctaaaccacagggaaatgttagaaagttaaagcttgaagagcatagccagatagcagggcttttacaaaggaagagaaatgtaaaacatgaagatgaggaaaagctggacatgtgtcccaatagtctttattgggcagttaagataaactcctgaaaatttaaagggcaaatatggtgctttagttgtttttctgttttgtaacaatatctttatttatctaccttgatgatttcacctgctcttcaatgtgggtcaaggacatggtatcctgcccatttctttgatatcccaaaacaaattcctgctgatggagtttctgccatttatcgtggaagactaaaaacataaaaattctgataattagaaattttaattctcaaaggacacagttgagaaatcctatgaatatgttattgaaagctctcatgtgcaactgtacatttcaaatggcccaccttggttttctgattaatatggaattgtgacgttagatttttggttatcaaaactttactgttagtgttagacctgccttttctttctaactcatgggtgttcaggattcttttttgtcaccaagaagagcttccctggccttttctgagaagcatctagtgagagaagtgtagcggctaagagaaggaagagttggggggcttgagatctgcaggctcctgggagaggcaagtcagctggtggggcaggccctgcagggtgcattgccatagcagtgggtgggcatctctggaaatttccccttcgaggagagaggctgttctttcggaagagcagcttcatctctcttttcttttcatggtggctggtagctcttttatccatttccatcctgttatgcctatggctcttcctcctcaagtaatatgtagctgcagtacagtgagatacagctcagtgcaaactatggaaagtaatggtatttagttagagtctgaaagcccaacttcaagatcttttactgccatttgttagggcatgaccttgggcatggcatttaacctctctgagctttggttttctcatccttaaactgaatattcatatttcatgtattatctgccttatagaattattgaggattaaatgagaaaatgtaagtgaaagtttatcctagggctatgatgatgattgtgattagtattatttaaaagcccagtgggtgggccagtttttgccacctagaaaaatataggactcctattcaaagtcttatggaacaaaaatcatcgctaacttgcttatttgaatttctataatgaagtaaaaatgcaagatagatggaatttttgaagaagctcctgactgttgaataattcttatatattttaaaaactgtcacaatataagtatttttaaagtagtatataatggttcctgaaaatacctgaaatgcccatccttttatacatgtttaagtatgcaatttgttctaaatgtctaatcttgaatgattaaataatttgcatactgttttcagtgctatgaattaaaggctaattgaagtataattttttcacagtaaaattgtatcatcttttatgtagtacatttaaaaatattctaggccagttctaattttatagttttattattttaatttaatgcaccaagtaattaaaaattgctgcaaagaaaagaagctgaaaatgattttaggtaatttcccctcaacagagtgaaaagatgataagtagaataatggaagagagcccaacacagttcctggcacataaagatattcattaaatattccttaatgaataagcaatgactaatttctaagtgtctctagactttgagaaaaggcaccattttcagtgctgtataaaatacaaagaagataggttgacatctttatattaaaatacctccatgcagagttcccacaagccaatttttattgaatcattagatctgcagtttgttctgctttccttttctctttgttcttggagtagattctcaggcctaagtcagttacagatattgagagacaattctccatggtatcatgcatttctgtatctcttgtaagcagaggcactgacttctctttgttctggactatctcttcaaggatgtttatatagcaagtagctgtggaagacaaaaatagtctctccctctggagcaaagtataggtttgcttatagcgttggaagatagaggcttagtgtctccttccagtctaataaagatagtagctcccttggagataaagagcagggatgcttattgctaattatagaagatttgggttccctaagctaagggttactctcctgtaatgtaacccactgcatgtacaaatgttacctggcccttactatgtcatcctgtgggaattggggcttaggaaactggaaaaagaaatgctgatatttaggctattcttactgctgttgattaataaactgccttttgtctctgaccaaggcacctcctgtcttctaccagcatccatgaaactatggaaggctaacttctcatcttgcaagtaggataaaatctcaaacccttttttctttttttcaaattcttttttctttttcttttcttttctttttttttttttttttttttttgagacagggctttgctctgttgcccaagctagagtacagtggtgtgatcatggctcactttagccttgacctcctggactcaagcaattctcccacctttcagcctcccaagtagatgggaccacatgtgggcaccaccatacccagctaatttttttttaattaattttttttttcttttgtagagacaggattttgccatgttgcccaggctggtctcgaactcttgggctcaagcaatctgcctgcctcggcctccaaaagtggtgggattacaggcatgagccaccatgcctggcccctaaacaatccttaacaacagattgcagcaatatttgggtaacttggctggtatggtgtggtatagttggtacactcatgtaggcaaggaactcttttacctccagtggctgaccactcttttggatatacgtgggaccctgggaacatattctcaagaggagaaatgaatgggcatcagggttggaagtagaagatgggatgagatctagagcttttggcccagagcactggctagaactgtgaagcctctgataaccctcacttgaggtagtgcttgggtggaggtggacagaggctatagaggaaggaggaggaaaaataggttgatagaggaaagaagattccatgaaacttcacagcagccaaaagtgattcatccttattgaaacttctaagtcaatgttggcacctatcattccaaagcttactagctttttttttttttttttttttttgagccatgagtacacatttttgtgagcattctgcattggtgccttaatgcctgttgagtgtgctcacattgagtgcttgctggtggctgaatgtgagcaggcttgttctaggaaaagacatgatggcagcgtctggtatttttcgtcattctgcttatgtcccctgtccttcatcccccatcctcaccccagtctttatggtttattaaaatacttcccaagcaccacttaggcaactctaaccacatgcaaggctggccacagagctctgaacctcagaaatctcagctcattctgacttcctcagagttggaatgtactaatgctgcttcctagaacgagtcctttgcccagttttctgttgcgggaaagtattcagggttgttagtgaatgtgctgtatcttcttacttgttagccacatgataaaacagttgtattttctttcatgccatagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggtaaggaattgacgtttgttgagttcttgtcttcaaaataaaaatccctttggaaagtcagtaaagggtgtttgtactcctgatgcagatgtgaaagagcttttagagccatagttattccagttttgttcttctttgggctagagggaaggctgagtgttagccacagagcaagaatgacttcctcactgcctcaccccaattctctctgtagagactctctctttcaggcagtaggagtcttcagtgaactgcacaggtgagacagattctaggcacccacaattgactttgtggtcactgatggtatatgagttgtatccacatttccttggcttgtgtttttgctttttagttgtctaactctggctagaaagatctttgcttctatactagtgatttagtgaagcaagccttgggtacacattttttcttcctcctaggaaattccaggtcctcttaggatggcattggatgccaagatgctctggaagaataaggaagaccatgattctgatataccccctttaggaaaggatgtttatgtacaaggtctgaccccagctagtgtaagggagtaaagactcaatatttttagtattatttttgtcttcctattttttaaacagtccctgggcccaaattttgttttccagaagaatttgaacactcaaaggggggtggaaggtgacaacacccagctaatctccttgctgggactggatcgcaaatgtcttgactcttaccctgatttccatcattgtcacttgtttcctttttccttttctattgaagtgtgattacacacagtaaaatacacagaaattaagtgtacagttggatgagtcttaacaaatacacgtacccctataacctacccccatattgagatgtagagcatttctcttcccccagaaagtcccctcatgtgtttatcgaatcgatcccgctccccaccacagacaactgctgttctcatttctatacccatagatgagttttgtctgatttttattgttttaaaacttatgattcatttccttgcagagaggtaacaaaatttagaacaaaattctcttttgattctgttttgatctctttttaaaagccacttgtaggatcattcatctattcctgcctcccagccccagcagaattattctttaatgttgttgtaggcatacagccctctggagaaatatatatattgttgatcctggaatatctaaggtgaaatgcctgtatattgatgtacaaagggattttttttggtttggattcatttttattttttccaaatgccctggatgaaagagtctagataaatagaaagaatttagaaccagcagagagaacttgaaggaaatggatccaaatgaattgccaccctttgcatatggctgcagtcattcactaacagttgttgttatatgatagtgattgtgaataatgatggattatatgaaaatgcgcagagcactgtgggatttcataggtttatgaagaaaaaaatttatgtatatttaaaattatactttaagttctgggatacatgtgcagaatttgcaggtttgttacataggtatacacctgccatggtggttttctacacccatcaacccatcatctactttaggtatttctcctaatgctgtccctcccctatccccccaccccctgacaggccctggtgtgtgatgttcccctccctgtgtccatgtgttctcattgttcaactcccatttatgagtgagaacatgcagtgttttgttttctgttcctgtgttagtttgctgagaatgctggtttccaacttcatccatgtccctgcaaaggacatgaactcatcctttttaatgactgcatagtatcccatggtgtatatgtgccacattttctttatccagtctatcattgatgagcatttgcgttggttccaagtctttgctattgtgaatagtgctgcaataaacacgtgtgcatgtgtctttatagtaggatgatttataatcctttgggtatatacccagtaatgggattgctgggtcaaatggtatttctggttctagatccttaaggaattgccacactgtcttccacaatggttgaactaatttacactcccaccaacagtgtaaaagcattcctatttctccacatcctctccagcatctgttgtttcctgactttttaatgattgccattcttttttttttttttaaatggagtctcactctgttgaccaggctgtagtgcagtggcgcgatcttggctcactgcaaactctgcctcccaggttcaagaaattctgtgcctcagcctcctgagtagctgggattacagaggcctgccaccacacccggctaatttttttttaaatatttttagtacagacagggtttcaccatcttggccaggttggtattgaactcctgacctcgtgatccacctgcctcggcctcccagtgatcgccattctaactggcgtgagatggtatcttattgtggttttgatttgcatttctctaatgaccagtgatgatgaactttttttcatatgtttcttggctgcataaatgtcttgttttgagaagtgtctgttcatatcctttgtccactttttgattttttttttttttgtaaatttgtttaagttccttgtagattctggatattagccctttgtcagttggatagattgcaaaaattttcttccattctgtaggttgcctgttcactctaatgatagtttcttttgctgtgcagaagcttgttaatttaattagatcccatttgtcaattttggcttttgttgccattgcttttggtattttagtcatgaagtctttgcccatgcctatgtcctgaatggtattgcctaggttttctttagagtttttatgattttaggtcttatgtttaagtctttaatccatcttgaattaatttttgtataaggtgtaaggaaggggtccagtttcagttttctgcatatggctagccagttttcccaacaccatttattaaataaggaatcctttcctcattgcttgtttttgtcaggtttgtcaaagatcagttggttgtagatgtgtggtgttatttttgaggactctgttctgttccattggtctatatctctgttttggtaccagtaccatgctgttttggttactgtaaacttgtagtatagtttgaagtcaggtagtgtgatgcctccagctttattctttttgcttaggattgtcttggctatacgagctcttttttggttctatataaaatgtaaagtagtttttttctaattctgtgaagaaagtcagtggtagcttgatggagatggcattgaatctataaattaccttgggcagtatggccatttttatgatattgattcttctatctatgggcatggaatgtttttccatttgtttgtgtcctcccttatttccttgagcagtggtttgtagttcttgaagagatccttcacatcccttataagttgtattcctaggtattttattctctttgtagcaattgtgaatgggagttcactcatgatttggctgtctgtctattattggtgtacaggaatgcttgtgatttttgcacatcgattttgtaccctgagactttgctgaagttgcttatcagcttaaggagattttgggctgagatgatggggttttctaaatatacaatcatgtcatctgcaaacagagacaatttgacttcctctcttcctatttggataccctttatttctttctcttgccctggccagaacttccaatactatgttgaataggagtggtgagagagggcatccttgtcttgtgccagttttcaaagggaatgcttccagcttttgcccattcagtatgatattggctgtgggtttgtcataaatagctcttattattttgagatacgttccatcaatacctagtttatggagagtttttagcatgaaggggtgttgaattttattgaaggccttttctgcatctattgagataatcatgtggtttttgtcattggttctgtttatatgatgggttacatttattgatttgcatatgttgaaccagccttgcatcccagggaggaagctgacttgatcttggtggataagctttttcatgtgctgctggatttggtttgccagtattttattgaggattttcgcatcaatcttcatcagggatattggcctgaaatttcctttttgtgttgttgttgttgttgtgtctctgccaggttttggtatcaggatgatgctggcctcataaaatgagttagggaggagtgcctctttttctattgtttggaatagtttcagaaggaatggtaccagctcctctttgtacctctggtagaatttggctgtgaatccatctggtcctgggctgtttttggttggtaggctattaattactgcctcaatttcagaacttgttattggttggtctattcagggatttgacttcttcctgggttagtcttgggagggtgtatgtgtccaggaatttatctatttcttctagattttctgcatagaggtgtttataatattctctgatggtagtttgtatttctgtgggatcagtggtgatatcctgtttatcgttttttattgtgtccatttgattcttctcactttttttctttattagtctggctagcagtctatctattttgttgatcttttcaaaaaaccacctcctggattctttgattttttgaagggttttttgtgtctctatctccttcagttccactctgatcttagttattttttgccttctgctagcttttgaatttatttgctcttgcttctctagttcttttaattgtgatgttagtgtgttgattttagatctttctcactttctcctgtgggcatttagtgcttataagcactaaatatataaatttgcctctaaacactgctttagttgtgtcccagagattctggtatgttgtgtctttgttgtcatttgtttcaaagaacttatttatttctgccttaattttgttatttacccagtagtcattcaggagcaggttgttcagtttgcatgcaattgtgcggttttgagtgagtttcttaatcctgagttctaagttgattgctctgtggtctgagagactgtttgttatgatttccgttcttttgcatttgctgaggagtgttttacttcccattatgtggtcaactttagaataaatgtgatgtggtgctgagaagaatgtatactctgttgatttggggtggagagttctgtagatgtctattaggtccacttggtccagagctgagttcaagtcctgaatatccttgttaattttctgtctcgttgatctgtctaatattgacagtggggtgttaaagtctttcattattattgtgtgggagtctaaatctctctgtaggtctctaaggacttgctttatgaatctgggtgctcctgtattgggtgcatatatatttagtatagttggctcttcttgttgcattgatctctttaccattatgaaatgcccttctttgtcttttttgatctttgttggtttaaagtctgttttatcagagactaggatagaaacccctgcttttttttgctttccatttttttggtaaatattcctccctccctttattttgagcttatgtgtgtctttgcatgtgagatgggtctcctgaatacagcacactgatgtgtcttgaccctttatccaatttgccagtctgtgtcttttaattgggacatttagcctgtttacatttaaggttaatattgttatgtgtgaatttgatcctgtcattatgatgctagctgattattttgcccattaattgatgcagtttcttcatagcatcaatggtctttataatttggtatgtttttgcagcagctggtactgatttttcctttccacatttagtgcttccttcaggagctcttgtaaggcaggcctggtgatgacaaaatctttcagcatttgcttatctgtaaaggattttatttcccccttgcttgtgaagcttagtttggctggatatgaaattctgggttgaaaattcttttctttaaggatgttgaatattggcccccactctcttgtggcttgtagggtttctgcagagaggtctcctgttagtctgatgggcttccctttgtgggtaacccgacctttctctctggctgcccttgacactttttccttcatttcaaccttggtgaatctgacaattatgtgtcttggggttgctcttcttgagaagtatctttgtggtttcctctgtatttcctaaatttgaatgttggcctgtcttgctaggttggggaagttctcctggataatatgctgaagtgtgttttccaacttggttccattctccctatcactttcaggtacaccaatcaaacgtacgtttggtcttttcacatagtcccgtatttcttggaggctttgtttgttccttttcattctttcttctctaatcttgtcttcacgctttatttcattaagttgatcttccatctctgatatcctttcttctgcttaatcgattcagctattgatacttgtgtatgcttcacaaagctctcgtgctgtgtttttcagctccatcaggtcatttatgttcttctctaaactggttattctagttagcaattcctctaaccttttttcaaggttcttagcttccttgcattgggttaaaacatgctcctttagctcagaggagttagttattacccaccttctgaagcctacttctgtcaattcatcaaactcattctccgtccagttttgttctcttgctggcgaggagttgtgatccttcggaggagaagaggtgttctggttttttggaattttcagcctttttgtgctggtttttcttcatctttgtggatttatctacctttggtctttgatgttgttgaccttcggatggagttttcatttggacatcctttttgttgatgttgatgctattcctttctgtttgttagttttccttctaatagtcaggcttctctgctgcaggtctgctggagtttcctggaagtccaatccagaccttgtttgccttggtatcaccagtggaggctgcagaacagcaaagattgctacctgttccttcctctggaagcttcgtcccagaggggcaccctccagatgccagtcggaggtctcctttaagaggtgtcaacccctgctgggaggtgtctcctagcaggaggcacaggggtcagggacacacttgaggaggcaatctgtcctttagcagagctcgagcactgtgctgggaggtctgctgctctctttagagctggcaggaggaacgtttaagtctgctgaagctgtgcccacagccaccccttcccccatgttctgtgtcccaggaagatgggagttttatctataagcctgtgactggggctgctgcctttctttcatagatgccttacccagagaggaggaatctagagaggtagtctggctacaaaatcattgctgagctgtggtggactccgcccagttacaacttcctggcagctttgtttacactgtgaggggaaaaccgcctacacaagcctcagtaatgggggacgcccctccccccaccaagctccagcgtcccagatcgacttcagactgctgtgctggcagcgagaatttcaagccatcggtcttagcttgctggggggatccactgagctagaccacttggctccctggcttccacctcctttccaggggagtgagcagttctgtctcactggtgttccaggcgccactggggtatgaaaaaaaaaaaaaactgcagctagcttggtgtctgcccaaacagctgcccagttttgtgcttgaaacctagggccctggtggtgtaggcacttgagggaatctcctggtctgagggttgcaaagaccatgggaaaagcatagtatctgggccagagtacactgttcctcacagcacggtccctcacggcttcccttggctaggggagggagttccctgaccccttgtgcttcccgggtgaggcgatgccccaccctgcttcagctcgccctccgtgggctgcacctactgtctaagcagtcccaatgagatgagccggatacctcagttggaaatgcagaaatcaccctccttttgcattgatctcgctgggagctgcagaccagagctgttcctattcggccatcttgccagccacccccagaaaaagatcttttgtgccaggaattgagaataaataccaagaacagctaagaaatgttttaaataatttcctttcagagtaggaacatcattttagcatttattccctcagggagaaaattcttcaataaatatagtaatctttgggaaattaggagtttaataagaggcttctatattgactttcatacatttacttctgcagtgtttgctgtcttgaactgtaaagttaaaattaaacaatttaacttagactgaaaagaatcccatatattatcaataatgcttttcttagaggcctcataatgccaaagaaacatttttcaatcaattgaaatagtggtcccataatttcatttaaatatcagagataagactgaagagtctttggaaagccatcatgtctccccactgtcttgggttaagactgcacctagactgccctcgacagatagaaatttcaaaaatttacaaaaagattgtataacctgatttgggataacatctcccttgtcagtgtgcacttccttatataacagtcctatttggttacatcagatgaaatgggggcagtttaactccacgacagggctgcgaaagtgcaaatagagggaagagttgcatcaagaagactatggaactaactagtggttcctgggacagaggacagccgaggcagaggctctgcagaccttaagaccttctccatttgctgtgctcctgtttctccggggcattcttatccttgatacctaaagctttttgagctgaaataaaacagtgaatatatttcttcccttttaccttcacaaaaatctttgaatgagtaagaattatgaacacatatgaatttcccagtgaaaagacaaattatgtatttggttgagatataattaatacggagtcaaacatataaatcttaagtatataggtcaacaagttttgtaaaatgtgtgcaattgagtaaccaacacaaaaatcgagatgtagaatatttttaccacctcagaaagttcctttctccccatttctggtcaaattccctacccagaggcaattactgttctgatttctgtcaccgtagattagttttgtctgttcttaaataagaattttaaatctttttgaaaagtcagttttaaaaaatattaaagaagtatagttttttctttttttaatctttttttttttttttttttttttttttttttttttttttttttttttttacagagtattgctctgtcacccaggctggagtgcagtgacacaatctcggctcactgcaacctctgcctcccaggttcaagggatcctcctgcctcagcctcctgagtagctgggattactggcacctgccaccggacctggctaaacttttttgcatttttagtagagacagccaggctggtctcaaactcctggcctcaagtgatcgacccactgtggcctcccaaggtgctgagattacaggtgtgagccaccccgcctggccagaagtatagtttagtgtattaatgtttaatatgaaaaacttcctcaaacttgtttgtctctattctttttttttttttttttttttttttttgagatggagtctcactctgtcgcccgggctggagtgcagtggcgcgatctctgctcactgcaagctccacctactgggttcacaccattctcctgcctcagcctcccgagtagctgggactacaggtgcctgccaccacgcccggctaatttttttgtatttttagtagagacggggtttcaccgtgttagtcaggatggtctcgatctcctgacctcgtgatccacctgcctcagcctcccaaagtgctgggattacaggcgtgagccaccgcgcccggccagttcttaaggttaaaactggttatagatgtgtatgtatctatgtcatagttgaaattaaaaacaaaatcacagaataatctgtagaaaaatatatcttttttgttttcttttctttttttttttttttttcgaaatggagtctcactctgttgaccaggctgtagcgcagtggtgtgaacatggctcactgcagccttgacctcctggggtcaagcaattctcccatctcagcctcccaagtagctgggactacaggcgtgtgacaccacatctgcctaatttttttttttttttaagagttgtgtttttgccatgttgcccaggctggtcttgaactcctgaactcaagcagtcttcccgccttggcctcccaaaatgctgggattacaggcatcagccaccatgcctgaccaaaaatatatctttatatatttgtcacttgattgtgtatatcttagaagtgattatgcaaaccctgcaactattattgacattttctccatttgcaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaaggtgagcagtggatataaccactttgaatttgcttgtgggtcaagagactagtcactgtttggaatgttgtgtgttatgactatatgatgatagtaaccatgcactagtgcaggtatttagaaacctttcattttgtgccctctattaatacacatctgtgaaagtaatacagagaatatgatcaattagagttggaacattgaagttaaggcaagtaaaggaaaaaagtcaaatgtaagaaaaagcacctattcatcattgagttcacatccagttttatgaaactaaatgactccttagtaaaagaattgcttgtggctttggacagggcactgcagactactgaagagagcccatggtttggtctgggttgtgaatacaaacacacacttatacacgtgcacctacatgtgcatgtacacatgcactcacaaacatacacatgcaagtttacaaaccaaagtgccttttctgaatgtagcaactagtcaccaactagccactagctagtggcagtgatgacttttgcattttatttaacattaaaaagagttgtcagattgatttctacaaatatttatggccatttgagagctcatgtaatttgggtgcagcagaaacagcccagacctggattagagttgtgagtctgccccttaatagctgtgttaccttgggcaaatcacttaacctctttgagcttatttccccatctttaaaatgtcataacatagtaaaaaaaaaaaaccaaaaaaacaccatctaaggacctgtaaacacctataaggacacttaagaacataaaggctttttcaaaagctctatgttatattttctttcttatttggataaagtgtcttcttagtgcacatgaaaaggttaccataatgctaatttccgaggcaaataactgctggccattcagtcctcaccgggaggctttcccagattctctgagcccactgctggaagccctactgcgtttgcttggaggcaggagaggcacaatttgtcccagagggagccctgggatacccatagcaggcaaccaggaggtgtcagaaaaacctgtttttagaatgactttgaaaaataggctgaatataaaataataatgacatacctgacatttacagtgtgccaacattagttaattcattttattcattcattcaacaaatattcattgagtgccacctctatgccagccctggggttatagtaagaaagggaatggattaaatcctaccacatcttgttttgattttgtcttccagaattgcccacctagagtctatcaaccaggccagataacagatcgagcagttctcaattcatatggtgactttataaagaaccaagcggatggctacctgttcgatagatataagggaaggaacctcatattttattacctgtttctagtgtgacttctttggaacctgaacagtggggcgagttacgtactcttctcttgtgagattgtgaatgaaatcgatgaatacataaatgtatgcattgtactgctatttatcagtaataaacatgctgaaatgtctatataaatatatgcaatgcattgcagtttgtaagtataatactacagtgctaaaataatactttagaatattaacatcaactggttgcttttttatttgatttttaaaatttagttattaaagattgaagttttatttttaatttcctttttttctctgggaaggggttcctggttctttggagggtccatggtgccaatgctatgttcctttgtcttttttagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattggtaagtgatacatatgtcaattaaaaatatttttaaaattaaattgtttgttccctaattaagattttactttggagtttcaaatgctaggctcataatagctaccacttattgtgcatttgctatcttccagccgtttgttgtcttatatattcctaacaattctctatggataggctcattatccccattttagaggtgaaaaaaaccgaggcttaaagggggctcatttgtccaaggttatacagtgagcaaagagtgagccaagatttgaacttgtctgcctgatgctgggggggtaaatgttttggtttagcaatcgaaatggaaatctgaatgcttttcttttcacttacttcttcttaccacaatggatatacctaattgagttattgagggaattctcttctgctagtttgctctacctttcctggtgaggctcagccaggttttaagcttctctcttctcagatattaactccattccagtaaggttagttcagttcagaatgaaaatgagtgattgattaagcacctactatatgtaggtcactgtagtagacttaggagatagagttgtgtaagaggtttctaggctggaaggggaactgagacctgcagcgagtgacaccgtgttatgagtgtcttggaagctggcggaggatgtgacgtgaaacctaaagcataaaccctcatttgttaaactcccctctacctgaggctccaggtacctgctgctgctaggaattgatgggacttgctgacctcccagtttggtactggagttgggatagtgggtacttagtcctgtacttctttctgaaccttggagtattcatatgaacacacttccccgaggggcaagatggaagccaagtgcaaccgcagcttcttgaaagacaaggtgctttgtcactagaatgagatgaagccatgttatgtgtcttgttgtccgcattgtgtagtattcctggccttctgggaatctttatattgtgagagaaggcacatcaagtacacaagggggttagagtgaaaaaggcttacagttttactcttaggttcattaggggaatttgttgcactgcatctgcatgccagattagtcaaaatgtatgggccctactggggccaaattggtggcctctttttattttctaaaattagtccccttcagtggacacagttgggcatatttgccttggggactgtggacaagaagcagccaggaatgtgcaggtggcagctgctatagagaagctgctggtggcccctagactgtgggaaaagaatttggcctttaataaatgtagatgcctgtttggaatccgtctttagtgtagaatgaaaatttaaatgtatatatcaagatgagtcaccaaaaaccgtaacttacacctgatgattaccttaatataaaggatgtggtgttccaaagcattatatgattccttaaacataaagtctaacttttggttgatgtttgtctgtcagcttggtgagaatatgaaagttgcatttgggaaaatgaatgtcctactggtgggacttagtatgttgttagggtcttaacggcttctctagaaaattttttgaggcagtgtgaattccctggtgtgctccaaatcgagccatcctgggtaaatgtatcagcttcaaatgtcctatggtccatttcagtcgagtccttgtgctaatttctttctgttcacttcttttgttcactccgtggactaattgtattatgtaaaaaaaaagtagtctgtgcctctaaagctaatataacatgagcattatgcatttaaacagaaaattatgcaaatgcaaaattatgatgcatttcatagtcacactgactttttatatttctcataacatatgttaaaatatcccatttaacagacactattattacacaacatttcttgtgttacaacagtgtacttaatgtaagtaaagactagaaattatatctatgatgaggtggaggggagaatgaatcagtgttctctgataatctttgcatttgcttttcctgattttttggtaaggttaaattaatatccttaatgttgcttagatacagttatttctgccattttaattttatttatagttcatctggtctcagcaattttttaaattgaccaaattacatgcgttatgttttggtatccttaaaacccaaaccaggacaaagtcccatcaatcattgtggttctgtcaataattgtggtcacatttcctcctttgtcaataattgtgttcagtagaaaacctgggtatctccactgtgcagcacgcaggaaggatctgacaagcagcagcaacacagctaggggcgtctctagcaggaagtcacgggagatttctaacgcagtacgccgccttggtgctttagtaccttctcctgtgtaatgacaccccaacatattttgggggagaaaaaatggcagacaaagagaaggagttggccacagtcccaagaaaggtacatggataacctttctatttatgtagaagtggagggcttgctaaaattccaagagacatttgagctcctgtgtaaaactcaatctcttaagatgattccttcatacatttaaggattctaaggagaaggtgattccatagatttcttctctttaatagtgcagtgggaccccctccatcagacagtttggccatcctgctggccctggcttgcctgccaggctgtagcatgtcactccctcattattttatgtgaatgaacacggtccggcagatggaggtctgttgatctttcctatagcatgaaggttgaaaaaggctctaggggttccagcaggtgtttctttcactaaaaggacagggatcaaatgtaaactgttcttacgtaggaatttctgctttaggttattatttgtctatcagtggactttcttattttttcttagtggctgggacaatgaaactagtaacaagattgttcattcttgttgctgttgaacacttattgggctatgcttagattcaacaaaaatcttaaagcacctttaattttgtggagtcatttctggccatctctgaatttttaggaacagcaggacatttaagatgagtgtttaatgattatttgagtgaattggacacttaaaattgcaccaataggatagaattggcttctggtctcatcacatggccctgatggacctaacaattttgtttcttttgcttcccctatgaaatgaagatggttgagatgggaggattcttaaagattttatagctctaacataatgtgattcacgaatttaggtttcattgaaatcatttgacatgggtattgaatacaagcacaagtggatttaccttgaagctaatgaagcgtaatctttagaggtcttcctttccaggggtcccaatccaaggccctggcctaactttgtcttagtaatttgacattctttgcctagaagagctttgcccaaattatttaagcttccagcctcccaaaacctgtattcatctctaggctactagaacataagcagtgaacgttgaggtaactgaaggcttttcccagtagtctttcccactgagatggtgaatagaaaatcaccacgaagaagcattaagactcctttgtaatatgtatcatctgtctgccaatttgttggaatctagtcaaccatggatgggcattcaatatatatatgttttgacaagtcacttggaattagaggaatcagataattaaaagacatatctgtctcaggatctagcagaatgccaacttgagacattggggaagatgctttgtacaaaaatgtatactttttcatttattcaatgaatatttttgaacacctaaaacacgcaggatgctgggatgatggaaaaccaaagtgaggaaacttgtcattcagctgtgagtccagagctttgtgaacgtatgcaaattacccagataaatgggatttaaagttggatcttgagccagagtttccaaaaagatgtatgtggtggtataaaagtcaggcatgatggagtggaaaagttctcagcttttatacactagatggcactgtgggtgcagaggaaagctctaaattggttcttttgttacttaaatctgttgcaaaaattatatggttgagaaaacaacagtgtggtataagccctgtaattctagggggaagtgtagaatgcagtcctaattactttgagattcaatatgtgtcctcttttggttagactgcttagattggtatgtagagttgtatgtatatgtctcctgttgaaagaaactcctcaggcccagatttttaaataatcacatacagctctcctgccatggctatgatgttcttcctgaaatgaaagaccaaacagtggtgtgttagatgtaatggttagcaatgatagagtctactgcaattctgcccaattccaagatttgaactctcctctttatttccaagacttttctttaaaatcaccataaaaatagcaatagttgaagctcacaagtcacttctgtactggcacactggctcccccctttcactgagtcacctttataaacatgtctgctgtaagcagtctctgttaggatgtaacaatactcttttggggattgtttttggggaaatttcacacaaaggctgctaggaagtctaaggacatatgaaagctgaaaatgttttcaacaagagttagaagtggcctcaagcccttagccttttgatcatcagttaaaaaacaaaacaaaacaaaacaaaacaaaaaccaaacaaccaccttaatattaagagttaggttatcttggatgaaaaattgatctccattttctcttccggaggtgtgcactaaaatttgtactcttcctctatgggaactttgacagtggaaaaggaaatatttgcttatgtagaactcctttcatacaggattgaaaacacctatgtcatactgaagcttggggaagaagtagaaaatagattctgtgggagtttgttttgttttgttttaggaaagatgtggcatctttttttgccatttatgttggggacaaacacagtgacttggatagaccaggtcaatatgttccttgctctggagagcacggttgcttctgagattgtacagcctcgcaaatgagtacctgaaagctcctaggctattacaaatatgttaccagctctctctccacctctctttcctcacagatgataagtatataaataaaatcaacagtatttaccgcgtagcactcccttggagagagtaggcagttggctattttaaaagttttttctttttctgttttgtttgttcgcttcattgcatttgagtgcaattgtagtcttttcttgggcttaacaaaagctacctggggccgtggctggtgagaggaaagttctgttttggtgtttgtttttgaactacatagggaagtactatgacctggagttactttggaggcaatggagggtactcaaatacagggtgcagtaggaggagatggtggatggggaaggataaaggtgaatagtcaggagtaagtcctgtttggaaaagaattttattagtgagtgttgactgagataggagagggctaaattacaggttaaaatgtggaacgagtggcctaaagtttcaagtttgaattttcatattattggaaaaatcagaggagaacaaaaaatattcagaaatgggaatgtgatgacaaaatataaacgtttacttatttgacatagattcttttttttttttttaacttttgaaccaatggtgattattaagtgagttccatggtttttgtaaacatgattgaaaagtactctcacaggattttgctgttttgtttgaaagagtttaaaatagtctacaaagatctccatgttcatcttgaaaacataacaaacctttcaaaacagccataatcagggcaaaaaaaatattgatgttttgtttgcctttgttttgttctagagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacaggtgcttgagggaaccatgattttagtctgatctttcccaaatgtgtttggggtttataacatagttctcatgacgaaacagatgtcacgcagctcatctaattgcaagtccagggagacattattataggcttttaatgaggttgattaacatgcacgtattaacaggttcttacctgagtgcttattttaataagtatcatctggaggcccctaaagtaatattatctctagtctatgttgcctttccatatctatctatatatctgtctcccgaaaataggaaagatgtagagtaggagttaacaagctctttcttaaagggtcagataggaaatatttttggccttgtgggccatacggtgtctgtcacaaccactcagatctgcctttgtagcgtgaaagcaccacagacagaatgtaaatgattgtgtgactgtgttccaataagactttttttatggacactgacattcaagtttcatgtaatttttacatatcacaaaatattactcttattttgatcttgccaaccgtttcaaaatgtaaaaaccattcttatctcaaaagtcatataaaaacaggtggcctggtagatttggctcactgactgtggtttgccaacccctgctatagagatttcaaggatttatacgtgtttttaaaagtgttatttggtgattaatgttgttttcacttgagaggttggttgagttcagtaaccataggtttctcacttggctgaatataattttaaatgatggactttcagaagtattcctaatagacatggagaaaaacctgcctgtaaatcatgcatatagaatgtagacactgccctcggctactttttgcttctgcagggagagcaggccctggagaaagaagtcaggggaaaagtggtggggaaacattgtaggtgcttgaataggatgtgggctaagggttacagtcctgtgtgagggaaataatggataaggagattctggggagaagcagtgataaagggaatgtggtaagtctaggagaaggagaagaaaaagacatcctgaatttcataaaattgattggggtcaggtgctgttgtagcacatttgaaggagagagaacagtagttatgttgtatctataaaagtggtaaaaattgattaagaattatatagaatgtcttaaagtctgcctttgctatgacatgatgtcctttgtctttctagaaataatcttttacttttaaggattttagggttctatttttaagttttagatttgatgcttctcaggagtggtccctgtactttttagaaatgctaattattgtgtctcccccacccccagactgactgagatagaagctctggggaaggggcccaacattctgaattttctcaagtcttccagtggattctgagacacaccagtgtttgagaaccactgatttttatcacataagagggttgccagcttatactctgtcctcccttatcgagaacagtgtttaggtgaggttccagggtaggacttttgatggctaactgctgtttttaaggacagccacccgaaggaggcgggcaggaagaatgtccctattgtaaaaggagagggaatttttcttataagtaaacaagatgaaatattatccagggtgttgtttctggaacccaggggaaaaccgttctttgtgagtagttgacttagtccctctttctgtctacactgggtaaacttgcccacagaacactgactgtagatggtattccatgttcttttcatgttgtcctggctggagaatggtagtataggcacaaatgtctctcattttgttctttctgtccactgctcaatctgtgccaggaatacactttcctcaagctcttctcacacagggaccatgtttccatagtaactagcacattcggctggagacttatagatgagtttgaataacccaaggttttaaaactgtaagaacctaaggaagatgatttcacaaagcatacaaagaatagttttttaaaatacaaataaactgtgaattgagacatggaattgtacatgacacattgattatatatatattgctattaaaaatgtacttggtgctattattatgaggttaatgctgatctatgagtcattggagggaatagtttcagattaaagcatatgagcttttgatggatataaagatcttctttattatctgggtagatatcactgcggtagcctgctgggcagattgtctagtctgaggagggagaaccaggataatatctttcttgctgcaccaggctgaattagttactctgttctttgtgtgcccacagtactctgttgattatatttctaataataatattactactattactgattactcataataagccattagtggttactatgtgctatgttacaatacttaatctaatttaatcatcaaatccttggaaagtagataatgttattgtacccattttttacatgagaaaactgaggctcagagaggccatacaacttcctcaaggtgacacagctaatttttagctgaactaggaactgaacccagggaaatctgacttctggaatttacctgtctttcgacagaacctatacatataacagtgcatcttaatgacttgtttatgtaatttgtgggctccttttagaccaagagctccttgagggcaggggccagctttattgcttccataagagttagtgctggctatatatttggggatcaatagtttgtctaagaagagaaggaatggatgaagaagtgagcaaatagaataaatgttcactcatccagttcttaatcatggatagaagagacagatgacttctcaccaggagggttattataccagacttgtgccagtcataaccatatagcatccaaaaattcatggtttaatcttcatctctgtcttgttacagatattgtccatctgctgtccccaccagtcattttttttcttcttttaaaaatgtttccccattaataaaaataagccttcatgtgtgttccaaccataagactctatagctctagatatatttgaggtttttagtaggtgtatagccctggatgagccattcattatcttagtgaataactagttcttgaatccctgctgtgtgccaagcagtgttctgggtgtttgtgatacatcagtgaacaaaatagacaccaaggcctgccatcgtggaacttatattctagttctgggaggtggaccatcaattaatacataagtaaattatgaagtatttacaagatgttaagtactgtgaaaaaaataaagaaggtattaagttgctgtggaaagaataaaggcagattgggagtatggggctgaggaacattcctggttgcaattttaaatagtgtggtcttgatggactttactgaggagaggaaatgtgctccaggcaaaaggaacagtcggtgtaaaggccctgagcaagaagtgtgcttgggatgtgcaaggagcatccgggaggccgacatggatggagtagatgagtaaagagcagagcacacagagaggagatgagagtgtatgggggactgggtacacagggctctacagactgtttaaggatgcttttgactttgagtgataagggggccattagaaaatttgagcagagaagtgacttgagctgattttcttcttaaaagaatcattccagtgtagtgttgagggcagactatagatggcagtggtggaaattaagactgggtaagaagctactgcagtagtccaagagaaaagttttggtggctcagatctgggtgagcgcagtggaagtgatgaaattaattagtggatcctggaattattttgagggtagggccagtgggattccctgacaaactggatatgaagtatgaaagaagtgaggagttaagatgactctcaagatttgggcttgagcaactggaagggtggagttgccatctactgagatgagaaagactggagatagggtaggtttagggacaagagtagaagttcagttttagaaccagttaagtttgggatgtctattagatatcaagtggcaataccaagtaggcagttggatacatgtgtgagtatagggttcagaagataggtgaatgtggatgccatcagcatgtagatggtatttaaagccatgataccaaattgtattaaagccttgagattggatgaaatcaccaagggagtgaatatacctagagcagagcatgaccaaggaataaactctggaacatccccaattaggagcttggggaaaaaaggaggaaccaacaaaggagactaaaaaggagcaaacaaggaggtaggagcacaaccaagagaatgctggatcccggaagccagtgaagcaagagtaacactgaaggagtgatcatttgtgccaattgctgctgattggttaagttagataggcacaaaaaattaagcattggaattggcaccgtggagatcattgttgacctctacaagagcagtttaggtagagcaaacctaatggaaatggattcaagagaaaatgggagaagaatttgaggtaatgattttagataactctgggctgtatgtagaaaaagttaagacatggcttcttgacctaggaacttataatttgtttggggacaacgggaataaacacatttttaaaacaaccatccaagagtaaaagtctatatagagctaaattgggtgtggccttacaattgatgcaggaggtataagtaggtggtcagctggagcattgtgataaaaaagaatattctgggaagtttgaaaagtagttattagggaaatatctgaaaacatttgcagtgcttctcaaagtatgcccaggggaccaccttatcagaatcttctggggtgcttattaataatgcaggtttctggagatgtgagctaactactgaatccccccatatctctggggattggactctggattctatatatttaacaagctccccaggtgacttttatatataataaactttgtgaactgctattctaaaagttttattgagtagattatattctcaattgatgagatctccagaacactagatttaggtgaaaaaaaaaaggcatattgaacgtgtgaaaaacccacacttaacatgtacacttataaattataagaagttaaatttacagtaatattccttttcctgaagttagaccttcctcagttgtttcagtgatatttctagtatctgaaatgttatggctttcttgtgtgagaggggctaccaaatctatttgttacatataaatccaattatataccagagaagatggttgacaaggcatagcttccccccacactatatgaggtctgtctgaagcctggaaactgggtacagagaaaacagccatgcagacctggctgctttgctcaggctgttctggggtgagccttccaaactgctgcacaccgtctcacatggggcctcaagcctaggaatcttggtgctatcctttttcagcccggattcttgtacagcctgagaaaggagcagagaaaagcactttttgcctctgcaaatcagaaatacttggtttattttttaaatcactgtgaacacaaggaaagaatgattttcagtataggagaccctgcaagggaagacttctctgcttagagttgtgacagaggacatggtttattctcctgtgtacctccctggggtaatgattttagttatcaaagacctctccaagggtttactgtttcttacaaagtccacctttcactagcggatatccacagacatgcttctgctacagaccataaatcaatttcttcagtgaccaggcaatcagctttggtaacttttaattctataatttgatcctatctttagtctactagactattctatttatgcatagaattctgagtgcaaattccaatcaatacagatctcataacaattttccataaacatttattgaatacttacaatgtaaaaagtattatattagataatggttaataagacaatctttgtccttggaaaacagacttgtaatggcttacaatacgagtgataagcactatttaaaaaaaaaaaaaggtgggtctatcatatttgttatagcatttgaaaaggaaaagttaatttttcccttgaaggaagttggggggttgctggggagctggaggagtgagtctgagaggggaggatgtgggctggaagacagaaaagtaaagggcatgagacagtgagtggtgaatgggggaggtagccccagatactggcagagcccaggattgcccaggcagtagggctaggtgcttgctcttctttccagcatgattattgtgattggtgactagccttgtcattagagaacagcctgttagtgcagctggtttgaacagtgtgtttatgacgtttgttttgggttcattttcccaatgtgttacccaggacatgtaaagaatcagagatatcttaatatactgagaaaattcctctgcatttagatttagaaccttaattagacgatggttgaactctttcactttggacagtttatgcctactatattaaagccatattatatcttttgcagacttttaaaaacataatatgtggaagattacctgtataatgctctaactctcatttctcttccatttagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggtaagagatatactcttcacagtattttcttgagaacattttaagtgtctcttcatgttgaaaattagggaacatgatctgattttgtagcttagattatctacaatagaggctttataaaaaaaaaccctgaacaatagggttctttttacagatctcttaaatgggaacctaaacatttaaaatgatagaagtggaacagttttggttggcttagggctgggagacctggggttacctccttcttgccactatccccacttccgctgtggcctctgaggtacctctgtggaacccaagggcttcaaaatcatggtctgagtaccactagttttacttgtatccagcaagccaagaggaagtctgtattcttggtagtcctacttacaacatttttgtttggctgtaagacaagaatcccagatacacaaattcaatcgtcagggtccatctttatctggtccttctgtctgttgaggttgttgccaaggttccagcactcaggcccacagaatgcctctctgtaatatgctggtaccactgtcattgctgaggagaggcattgacttgcccaatcatggcactgtaggatcctgttctttgtctcaacatgtttagaacttttatcagtgctgaagacacgcatttgggaagaataatcagtgatgtgctggttaactggctctttgaaaatattttaaaagccctgatttgtactgtttgccagtttccatggtgtgaataccccaaccatggccaatttcaagcagccaagagtttaaaaactggcttgcaaaatctctgaaaattcaactgtcagctcctatgagctggtatgagctacttagcacaccaatgagtaaggaataacttgtataactaaggctccagagtgatttgaataatggatcaaatcttaaaatatgaaattgcctagggatgaatataagtcatgctcttacaggtcaaaaatcaactctatacacttagaatggggaagatgtggccaaacaagttgcagcatgtatgaaatagaaaggagtgatggtagtcaacaacaagcttactagtaatcctagtggccatgattgagaacttactattatccttacaaggactttatgaggttaggttttgtgttagtccagctcctctaagaagcaaatgccaagacaggattaaatatgcaagagatttaatagggggaatgctggtgagggaaaatgtggaaggagccagaagaggctgggagagctg[450 bp omitted]ttgaatgtggtaggaggagtgggatgaagtgaccaaaaagcttatctggtctcaggctatatttataggtctgtagatttcagttcagtatcagaagatcctggagttccctgttcaactctactggctactttccaagaggtcaaaacaaataatgtctagaagagaacagatgaaatgatgacagttctggaaagtaagaaatatgaggcattactaaaagaagcaaaggaattttacctgtaggaaaaaaagacttaaggggactcccatagttatctttaaacacttaagtaatctcctttacagaagtagggcatttgctacctaatctgcacgtcagattaagtataagacatcatctgggacaaataggtggaaataagcacaagtgaggaattttctaactggtactgttcaaacgtgctctaaagatgagtgccttcctgatgttccacactcccagtatgctgctgggcatatataggaggtccttgccaagtgtttattggactgggaagggagtagacagagagaagaaaaggctagaattacacaccattttttctctgttttttcttttttttgtttttttgagatggaatcttgctatgctgctcaggctggtcttgtactgctggcctcaagtgatcctcgtgcctcagcctcttgcgttgctgggactgcaggcacatgccaccatgcctggctttgctttttgtcttgaacatcctcacctaggaagtcttatttcttcactcactgcctcattcttcccttaagtccaaaaataacaggcaatatgagttcacaggtaacttatatggtggtctgtgcttgaagataaagtaactctgaaggcaagtcacgtggttcttttaagaataaaggctgctcatgaacttttctattttttataggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataaggtgaatttactttgtataattcttgacttgcctctcagccctccgcagtctgtgtttttctttctctagggccttttcttcttcatcttgccaccagttgtacattgtgcattcacacatgtgggcatgaataatggattcgtgtgacttggccacatgtcccatcacagaggccaggttcttgtctactctgtttacatgctgggttctcttctgcccagcatcacggattccaggcacaggcaggaggcagggccagggttgaatcaagtttcctgggttttctgctgacgctaacaatgttttcagaaagaaattcaacaactataggaaaggaagaaaaatctggtgccacacactgtgccgtcccagttaattggcacaggccaacagagaaggccaagacctgaacaaacagaaacctcaagggaactgaatagttgctgggtttacaacttcccataacagtagccacctgaggcctaaataaggatttaaggataaactggcaacagtgagctcaaagagtttttttttttgaaataagatggcagatgggtactgttactgcaagtgccattatggcaatgctgttcggtaaaaataacatattgataaaatcttgattttaaatgtggactagttcggtgtacaaacatgtttatttgggagtcattgcctaatatggaaaaatctatctggaaaattttattttaaaagtttacctataagtgataatatttatgtgccatttatatacatacagtgccaattttgtctcatttatatataaaatggctggggttaagttgctaagattgatgtctctgtgtacatcacatcattcatatcagtttggatcctctgagaagcagacgccaagacagaatgagaagtgtgagagatgttgtggtggaaatttctgagaaggataaagggggagggggcaggagtgggcaggggggaccttcagaccgggaggcaggttgaacccctatggaaggagagcgaaaggaaggaggaggggtgggtagggagagcctcagctgacaacacagctctgagaaagtctcaaccaggctgatggggagccccagagcacagactgcccatcagagaggtcccctgtcaggcaggaatcacctggttctagtccccctgctgtgctgtgtcattgggtgggaacagcttggggagagtgtggccccagcagcgacattgcctgtgaactctgtgtgaatccggaaggtatggcagctggagtctgtcagccaacaatgctcttctccacagggtctctcttgataggaggcctgagaagcgccctccatggctgccatgccatctctccatttgtagtcttagggattcaggttatcataaaaccttgaaccagtagctattcgaaaacactgaatctagatgagaaactcagtaattgggagtttagatttctggagaccagcaggcctggcttgggaacctgactccacattaatagctgagggaccttagatattgtatttttcctgaacttcagtttcttcatctttggaatgggaggaacaacagtgcctgtttgatagaattgctatgaagattagatgtgataatgtgtatgaagcgctgagctaaccatgaggcccatggtaagctcaatcagtgttgctattgtaaattagagttctatttctaatcagagggtgagcctataccttaatataaaatatatatagcataaatataagatataaaggtttttttttcctttgaggacaataaaagcagggtaggacattatctggaatcagcatcccaagtcaaaactgcattattttaaaactgcccttaacaaagacattctaagcagagaaggattgctatactatttaatatcagcctgaggaatcttttcaaaagagctaatagatcctgtcatggaaatagatgaaaggaaatgcaaaaaaagtgggaggagtaggggtctgcgataggtgccaaaccacctggatcattttctggtgggagagagggatctttagactaaattgccatcaatatttttattttaaaatttaatctcatttttggtctcttacctataattatttacgaccttatgtttcactggatgcaagaagtattcttaccaagtcaaaaagctagtcacaggataagagacaggaacagtggacggcccagagaatgactgtgcgagggttagggtgcttgcgtggatctttgatacccagccttgctctcatcagtgcgttgcctaatggacagcagttccagggggaccccattctaaagatctagagaaaatggagggctacttatccagttttgaatccccattttctccattaggatctcccaacatattgggccactatccaagggttagagggaggaggctgagatggaagcaggggttgttttctgatctctgtggcctggtgttccttaagctcatttccctcagagctggggcctatgctgatgtcagctgttgtccagaagctttaattgaggagatacaaagctagtcatgccttctcggtgttggtttctttgcaaagacaaatctgctaacttcatattcacagtgtgaagtccctttgctggccatcagcaagattgggctcctgaactgttaggaatatttaaatatgtttttcctttcatttcccccttacagtatcctttcagtaacctcaaacttgccctacaaaagctgaagcaagaagaaggaaaatccagagagctcaagcaggtatttaaagctgctgactctaagcacacaaatatggtggattataatacattcaggtaagccatattctgctaacaatcacctgttttcccctcaaggttgtccaaagaacagagagaactatttctttcctaatcagttaactattttttattaggaattggcatttctttgagtttgtattattttgtggtaaagttttggccacgaatactctagtaaatgttacgaatttacatataaaaggagtttgtacatgagaacagagggacaagagcatagaaagtcagctggtcacattgtcttatgaatcaggaggttgaaggatcagcagaatgccaggaatgatgcatctgagtgagaaagacagaaaaaagcaccgctaagagcacgtcctccctaccaaaatctgggggacaaaggagggacatctccaggaatgtgatgaagttggaaaatagtaaaaacttcaccgattatcagagcaaaggtgatatgtatgcatctgtgtatacatgtgcttacacacatatgtgtattctgaaagacatgaaaatataggaatcgagggaaaaatatatgacagtagttggaaatattataacaaatcatgattaagattttctctaaggtgaagctgaattctgggactatccagtggctgaccgaggcaaatttccaaacagcagaaacacagggaaattcaaattcagggtctagtacaatcgtgagacttcttaggctgaaaacaaagtgaatggagcatttaggagaataaattaaatcatggatggaggacaaaggggactttctctttaggctgagaattctggctcctgacaacgatagtggctgaaagctatatagtaaactccgcttgatgcagtcaagatgtgggctgagaaatgaggaagtgagcccaggagagggtagcagggaggtctttccaactttgtgtctgcagtcgcctattgcatcactacctggtggcctggagcccaccattaggcccagagtgtcccaagagctcatttgttgttttaacaaagctcttttgtgtctccaaaatgttctttggagagaagcagtcagaggacatatttttattgtttagaattcccaaccttctgggatcaataagaatttatagttctttgttattgttcatagtcacatacacatgttcatagtgttttggaaaataaatggagacagtaaagagcagagacaattacacaggccatgggctaatggaaggcagtggaggtgaaagcaagaaatttccatcagaaatgagggagtggtttcgttttattatttgtgtccttttacaaaagcatccatttttccagcactcgcaaagtctattggaaacactttagtgagtttatagggctttttgggaagcacttaggccaggcaggcgatccaaggaggaaaagttgctttgcagatggaggcctgaccctaattgtgggtgggataaagggccactacgctgtgattggaggggtggcctcaaggagctgcatgctctaaaagaaggacctccccgtcccagaaattccttaaaatgaaactcagatcaggtttcgcctggcttgaaaaatccttcagtggcttgccattgtcctcacaataagatccaaacatttgactgcagccagcaaggccttgagtgatgtgagtctgtttgtatttccagtgtcatcacctctttttctgcagccctgtcttttggccttactgactgtctttcggtttctcaaacacatcaagctctttcctgtctctgagcctatgcacaccaagttccctctgcctgaaatgcagtcaccaccatcctctgcatggcacactctaggactcatctcaaatgccaactcccagaggggctttcattcagaggggctttctagatcctatctagagtagatcacctgctgttattcttagccacttgtttatatttttcacagcacttagcacaacttgcagttattttatttagagatctgtttacttgggggtggggtatctatgtgtatgtgctgtgtgtgtcttctcctattcgaatgtgagctttctgagggtggggaactcaatggtgttgttccctgcagcatcccctactgctgggctcaatacatatagttactaaatgaaataatgaaccactagagttgttcctgggggttctagtttggaggtgatggcatggccttcaaatgagagcgtagaccaagagtctagatgtctcaatccatatgacatgcttggtgccggatgctgagccctctgtgcttggggctgctcatttgtgctcagcccacaaatggtccctgcaccttgtcttcagccccatcttatgcttttcaaactctttgagcaaagaaaaaggaactacatagcccgtgtctatcacatcataccctaattcaattctttgctcagtgcttttactagctaatattttcctttcattatgtatgcgtatgtgtgtgtgtgtttgtgtgtgtgtgtgtattctgactctcctcatcagaatataacctctttgagggcagggaccttctctttcttgttttctgctttagccttatgacttatttcagtgtctggcaaacaatagggtgttaataaatactagttgaatgggtacattttttttttgtttagtgtttaatatgcctcagatgaaataattctctgagataattctctgcttttgtgtcttttgtgttctaccttctctcttttctcttctccttccttccttccttccttcttctttttctttttcttttttttattatactttaaattctggggtacatgtgcagaacgtgcaggtttgttacctaggtatacacgtgccatggtggtttgctgcacccatcaacccatcatctacattacgtatttctcctgatgctatccctcccctaggtcccgaccccccgacaggccccggtgtatgatgttcccctccctgtgtacatgtgttctgaatgtgtacattttatctagccctcactgctttggctttgacctgtaggctgattgtgtccatgctagttcttcaagctcagacctttctcctgagctataaacctggaaacacgaatacctctgggacgtttccccctcgcatgtctcttaggcatcccagaaataactttccctaacttgacctcattttcttctttcataaagtagcagctaggagactgtatcctgataaaggccatcatgggcatccccaagagtccagaccaggtgttggctttgtgtctcccctctcccctctctcgacctctcccactcaccctttggaattatacgtcttgaactacctctgggaactttcccttctttacatctgcagcttcacggttgtagttcagcttttcatcactgtttacttggaccctctggagagcagtgtaactgatctctttttcttaactctcatcctgcaaagttttgccagagtgaccttcctaaactctgatcggatcattcttctgctcttaaccctgcatcagtgtgtcacatgagtttgcctacctttagctccgtatttccatctcactagaagaatacttttgtagaagccaccatgtattgagcacttactgggggctaagcatcgtgctaaatgctttatacctactcttcactggtagcctcctgtcaagttgttacttgtttgcttccctgcctccacatcagctcctgccaagtgcaatagatgtttgctgaataatttaatgaacgatcctatttctcaaggaacgttcagtctaaagcttgcagcaatcaagtaaataattgatttccttgcaccagggaagggccatctggctcttacttagggaagtaaggagaagctaggcctgatcctcactagccaagtaacttgggcaactcacttcacctacctgtatctcactcatttgttcatatattggtctctgaggtcccttctaggctctgacaactggaaactctgaaaatgtaagtttataatattcttgtaaaatgttctcttttcaaatttgtacattgagatagtagagaagagcagaggcaagcaaaggcaggactgcagcataggcctatgggcttggcctctgtggccctgactctcttctgcttagatacctggcactctcagcatacacctggggcttcggggcccagacctgctgctctgggcagtggtccaagcccccagcattgccctttttctcagagatgtgcatctcctctcagaaaaactttgagggtaggagctgataaactacctctgtataaggtgccatggtcaataatggattaatgtgtgggcctctcggagatatttgcctcagaatagacctgatggaatgcagggacaggcagccatcaggaaacagaagtagggaatggtttttgttttttttttttttaatttttttatttgggtagggaacatttctcttttgccttgtgggaattcaccacttctgcttctgtttcattgatcctctttagaatctttttggcatggtctatcagattcgcctgtgagagctgctgatcgttatccaagagagtgcagataacctttcttagagccttaggatagatacctggtggcagtggtgggcagatttcagcagggagcagggcagggactaagcttggcagggctagtatttcatgcagttgggaacataggcagggtggggcttcccagtgagggccctggactctgaaccacaggcagcagcagcagcagcagcagcactgagagcccaatgccaaggaagatgtggtcagtccatctctctggccacctccctgagccttgatctacccatcagagatgacacctggccccatgtagcctgtgtgtattttggttagctgagtgcttgtctcttctctccacctggggaagctctcagagggcagggcccatgcctggttcactcttgtgtctttcccagatgcctccagaacccagtgtatcagacctcaatgaacatagtgaattattacagattttttcttcaggtccccgttatcagttgcagagtcagtagctctcctgtgaacatccatgtaataaattccttctaagatttagaacctcaaggagattttctcccttgtaaaactaaaattcttcctaaaagaggtaatataatagaaatagttcttatcactggttttggagttggcaaacccagatctagctcttggctctcttgtttaccagcttagtggccttggggaagctgctgaataattttttcatctgtaaaatggggatagtaatacataggacacagctgttgtgatgaatacatttgatactgatattaaaattcttattgtagctgactagtgcatggtggatactcagaaagtgaaaatgctttatcccaatagttgtgaactggtgtcaccaacaacagtaataggaaggtacatcttgtttccagtatttcaataagctttatatttactcatggtgggggtcattcaaaacattctttaataaatgaggttgaaagagaaactctaaaaacttgtaggccttgaagatggaaaataataaacatcattgttggtggaccaaggctgggaaacattaatataatctaccctattgctgtcctttacttcacggaagcaaattgtaaatttagtgcttagaacatggtaatgatctcatcctgatttatctaggacaattatctctccttttatatggttttgccctatttttatttggactactctgtgtacattgctattggtgttttttattgtaagcaatctagcatcttttaaggaagccactagtctatgaatctatatgaacaaaagcaaaaacaaagacaaataaaatcccaaagcactcaaacataggttcttatcatgaactaaatagattcttggacagtattcatagcctgtcttcaaaatggaaatttccatatatgtttttgaaaacagcattttgaactttcctaaaagcattaaatataaataatgtgatgttgtagaaagaatgctagcctgggaatcaaaaagatggagatctttgatttgattctgtcactgtctggtggtggtgtttgtattggtgagggcttagttttaaaaaggaatatcctctctggctagttaagcaaaaaaaaaaggaatttattaaaaggagcctgggtggttcacagtgtctttggaagggctggagaaacaagctcaaggctgaactataggaacagtgcccaaaacagggctgtagaacttgtctgatgagaaaatgacctctgttaccaccacccatgactcattgctgcacttgcattgctgccaagaacttgattttaccacagccataactaccactatttctggcaatcgtcctttaccacccctgaaggctgggctcctttgacaccaaacgtggcccaccctgagctgcttttcttctgttaatcccttctgaggcacagtcttaagtaagcttccctgattggtagagagcctgggtcacctgcatatttctaactgcaaggaagtctgggaaattgagctctgacctctatgttggggtggtaggaaacttacgtgggaatttccccaaatatagaaaggctatttaaaagatagcctttgtagaaagtttcagttagacaggatgaataagttctggagatctggagatctattgtacatcatggtgactatagtgaataatgatgtattatatacttggattgctaagagagtagctcttaaatgttctcaccacaaaaaaataagcatgtgaggtgatagatatgtgagttagcttgagttaattacttctaaatgtatacctgtatcaaaacattacattatgtgctgtaaatatatacaattttatttgtcaattatactttaataaagctggggggaaattgaataaataaaagatacccttttcatttgccatgaatattgcagggatagtaaatccaaaccaacatgagccaaacagggaacacgaatatatgttgacaacagggacaaagcacctacctagttttagtactttgaaaatattgttttgactcgccaagcagctaaacaagaggcaaagccctcccctacgcttggctacttttgcaatctctgatgaacttttctgagtttccattgccttaaatgaaggtattggattaaaaacaggtttataggttgaaagctggcagttatattttgtatggcttttgtttaatgtttttaaaattgggagtttaaacctaagaatatatatatctggtgcctcttggaaaatagaaattggacccacatttctctatggcaacaatcttttgggggtgaatggcacttgccctccttagatagagcctgttctctgcatttcttctcagtttctacaagtccttattgtctcacgctaaggcactttctcctatttatcttacatacctaccccagtaggtactagactaggtaattcttggattagatcatataaggcacctcccagacataaaattccattattttgttactctaggtattgtggaaataggcatttaggaatcactgtataaatagttcaaaatagaactgaagactaattttttaaaattagaatccaaatatgattgtatacttggaaaatccaaaggaatcaattttaaaatggttggaactattaagagtattcaggaaagtagctaaatataagaaagctatatatagaacaatagctttactttatatcagcaataactagttaagaagtgttctgaaaaggggaatactatttgctgtagcaacaaaaatgaaatatctgggaataaattggacaagaagcgtgagactaaaatgaatgcaatttttaaacttgatatctctgaatgggaagacaatattgtgaaaattctaattttccaaatttatagatttgaagcaattccaatcagaattgcacagcaggtttttgctcttgctgttgttagatttggttttgtttaacagggttaagggagataaattgactgattgattatgaaggttcatcaagaagaataaggggttgagaatatccaagaaaatgttgaaaagaatattaaaatgtagatactagaaaggtatatgatttacatacatttgaaaacattttctagcagagaaacaaaaatatcagtgaaatacagtgtagagtctatagaagagctatttttatgaactttcgtataagtatggagaacatttcaaatcagtagagaaagaatggattattaataaagatttggtgacagtcaactagaaaatgcctttatacgcttattttgtggtggagcacagtttccaaaagccataaaggaaagattatattgactacagaagaattttatctctctctatggcaaaagctatcacaaacttaaaagacaagggacagactaagagaaaatatttataaccagtgtaagagccaggggattaacattaagtacttaagaactcctataaaatcaacacacaaaaatggatcaaaggcaggaatagttcacagaagaaatacaaatagtctttaaacctatgaaaagatgcccaataatgacacaaactgaaacaatgatgaaatattatttccacttactatattggcaacatttaaaaagaataatataactgactccaggtgaacatgtgtggtaacaggtactctcattttccactgataggagtttaaattggttcagcattttggagggcaatcggcagaatgtgtctaatgtttagactcttacctggtagttgcacttgtagaaattttttatttgaaaaaaatttggacaggtggattgataaatatatgtgtatgtgcatgcacaatatttattgcagcaaattttgtaatagtaaacatttagaaaaataaaatgcccaacaatagggaaatagttggatatattctattgcattaatttcagacaatattttttagccattagaaagaggtagaccacataggcataacagaaaaaatgtttgatgtatcagttaggattgtctaagtaatgctgcagtaacaacaacccctgaacctcagggaattaaaccaaccaaggtttattgtttgctgactttatgtatccattgtggttgtcaggggaattttgttcatagtagccactcagagactgaggctgacagaatagccactaccttgaatgttcgcagtcacattgccataaaggaaagagaattttggagggtcaagtacaacaaattcttacttggcaagaaatacatatcatttacactctcaatttattggctagcactagtcacaggaccccactcatgtgctcagaagaaggagggaaaccagatcttggtgaacagctatgagtggctaccacatatgtgttgtgctgttttgtagataaagcaaaatccagaagtgtgttaatatcctacttatgccaaaaatgtaaaagttgtgtgtgcatgtatatttatataaatatttcaaggaatgtatatcctttgaagaaatgctagcaggctacacacgaagctattagtggagtatgcttcattccttgatttttacttttttttacaatgagcaattattttttaaaacttcaatttaaataaaataaaacccaaacaaataaaaccaaaaagcctgggaaaagagcttatggaacagtttttcagaaagaacattttttatttcttgcttcagtttccagaaacagctaatggcagatgctggcagaatgttctgagcaaaagtcaagaggcttggaatcatagagtagcgcacaggttgctgtagttggtactctacctactctgattattgactacagtcacataattgtaatgtgcttacttaaaattcttattttaggggccacaatattttatgtttctgcaattacaaagtttcagaggtttaaagttaagttttgagatgaaatagtttttataattttcaaattcctatcaaattagcatgttttacccattcattttctccaacattttatgaaaattttaaaacatccagaaaatttggcaagattaaacagtggacaccccatatatccaccactgtgccattaacctcttaactttacttgctttgtcacacatctctccatttatacattcttatatccatctattaacccatcttaattttcgtgcatttcaaagaaaatcatagacatcagttacctccctctaaatattttagcatgcttactatttatttatagtttttcttttgatgtgaaatttatgttcaataaaatgcacaaactttatacatttgctgggttttgacaaatgtacgcttgtgcaacccagatccctactaacacatagaacattaccatcactccagaaagttccctcatgctccatcctagtcaattcctgtgcacatctgccattcaagaggtaactactgttctgatatatatttttttcactttaggtgctttttttttttttttaactataggtggtttttctctgttctagaatttcatatgaacggaattatacagtgtgtactcttttgtgacttctttcgttcagtatgattttgagattcattcgtattatagagtgtatcactaattcctttatattactgagtagcattcaattgtatgaatataccaccatttgttgattcattcccctgccaaagggtacctgggttgttttcgatttggggctaatatgaataaacctggtctgaatattcctggcacaaatatttttgtaaacatgtgtttttatttctcttggttatacctaggaatggaattgctgggtcatacataaagtaagtgtgtgtttagtgttttgagaaactgccagaccttttaccaaagtggttgtatcagtttacatttccaagtccacattgtcagtcttttatggttgttgctttctgtgatctgtttaagatgccttcggctggctcaaagtcgcctaggatagtctcctatgtttccctctaatagctttatggttttagctttcgcttttaagtctatgacttatctcaaattaaattttgtatatggtgtgaagtagggatcaaggttcatcttaaattcttaaaatgcttatttggaattcttatattatgggccagcatattttatattaaagtaaagaaaaaaataattctagagctttagaatataattttgaaatggaagagttttcataattttcaaattcttatttaattactgatgtcttacccatactttttttttcttattctatggtatagttttgactgttaaaatatcaaaatctcctttgcaaaggaagctaaaatactggccttttatgttttctcaaatcttatagttttcaatagtttccttatgtaatacattcgtatttcttaaaaattgaagtattctcactaaaataatatcttagttaactgaggaatgctggataccaatgatcttattaactgaaagaaactgtatactacacatatagtggattatattttccaaagattgcttcaacagtatctcctatccaacatgctcccctataatgtgaacttgacccttcttcttctgagggatagggctatgtcatttccccttgaatcttttttaatttacaatttcttatttttgtgggtacatagtaggtgtatatatttatgggatacctgaaatgttttgatacaggcatgcaatgcataataatcacatcatggaaaatggggcatcctcttaagcatttaacctttgtgttacaaacagtctaatgacactctaagttattttaaagtatgcagttaaattgttattgactatggtcaccctgctctgctatcaaatactatcattcattctatttttttttgtacccattaaccatccccacctgctgccctcccctctcccccactaccctttctagcctctctgataagcatccttctactctctatctccatgggtttgcttgttttgacttgtagatcccacaaataagtgagaacatgtgatgtttgtcttttgtgcctggcttatttcacttaacataatgagcaaatttcattctttttttttgactgaatagtactccattgtgtatgagtaccacgttttccttatttacttacctattggtggacacttaggttgcttccaaatcttggctattgtgaacagagctgcaacaaacatgaaagtgcagatatctcttcgatatactgatttcttttcttttggatatatacccagcagtgagattgctggatcacatggtagctctgtttttagttttttgagaaacctccaaactgttctccacagtggttatactaatttacattcccaccagcagtgtacaagggttctcttttctccacatcctctccagcatttgttattgcctgtctctcgggatatgagccattttaactgggataagatgatatctcattgtacttttgatttgcatttatctgatgatcaatgatgttgagcatcttttcatatgcctgtttgccatttgtatgtcttcttttgagaaatgtgtattcaaattttttgcccatttataaatcatattattagattttttccctataaagttgtttgagctttttatatattctggttattaatcccttgtcagatgggtagtttgtagatattttctcccattctgtggcttgtctcttcactttgttgattgtttcctttgttgtgcagaagctttttaacttgatgtgatcccatttgcccatttttgctgtagttgcctgtgcttgtggggtattacccaagaaatctttgccccgactgatgtcctggagagtttcccaatgttttcttgtagtagtttcatggtttgaggtcttagatttaagtctttaatacattttgattttatttttgatttgatatggtgagagataggggtctcatttcattcttttgtatatggatatccagttttcctagcaccatttattgatgagactatcttttccccagtgtatgatcttggcacctcccttgaatctcgagtgggcttgtgactcatatgtaaccaatagaatatgacagaagtaatgctgcgtggcttccgaggccaagctagaaaagatgcaggttgtgcattgtctgctgtgacacttccctttggagtctgagctactgtgtgtgtaagaggtcctgccaccttgaggctactatgctatgaagaagcccaggctacacggagaaaccaaccacatgtgggtggtaatttgattgagagccccagctgatatctcagctaatggcccttgtcaggcataattcaagcctccagttatagaatcttccaagttaaagctccagacattcttctgtgctctgtctgaattgctcactctcagaaaccatgaaaatagcaaaatgggtgttattagctgttaatttttagggtagtttgttaaaaagcaatattaactggaacagcatacatcaatgccttccagggaaatgaaatactgaaactatactgcattcacacgaagtatttaatttttggttatttggagaacaatttgatatcctttagtgcctcaaggtcatggctttccagttttttaaatgcaggggtagagaaatctcatgccacatcttggaagaatctcttgttcaaagaccttcccttgtcatacatataattaaaatgcagaaatatgtatgtatgtggatatatatagatacatacacacgttgtgtgtgtgtgtgtgcacgtcaagattctttgtacttgtgtcttccatctgcaagaacagtagggaatctcttcctttcacctgaattcagccaggtgaggtggaggcttttgtgagtttagatgtgttttccatccaaagaagatgtggtctccttttctaagaccacatttgatttttaaaattttaatttaaattatattcatatacaataagattcacttttttggtgtacagttctggttgtgatgccttcctagagttgtgtaactgccaccacaataaagatacaaaacaattctatcacgctgccttcccccttccaacacccaccacccccccccaatggaagtatgctttctcttgagtaaacacataggagttgaatgtcttgatcatatggtaggtgtatgtttaaactttgtaagaaactatcatttttttgttttgttttagaggttttctacatctttcattagatttttccctagatatttgatatttttggtgctattgagtggcataatttttagtggttgctctagagtttgcaatatacatttacaactaatccgaattgtatcagtcagttctcacagtgctatgaataactacccgagactgggtcatttatgaagaaaagaggtttaattgacttacagttttgcaggctatacaggaaacatgactgggaggccttaggaaatttacagtcatggcggaaggtgaacgggaagcaagaaccttcttcacagggtggcaggaaagagagagagagcaagcggggaagtgccacatgcttttagaccatcacatctcttgagaactcactatcatgagaacagcatgagggaaatctgcccccatgatgtaattacctcccaccagttccctctcccaacactggggattataattcaacataagatttgggtggggacacagaaccaaaccacatcataagttcagtttcagataacactatactagcttcaccagtaggcaagtactccttcccccttctcttgtatcattgctgtcattcatttcacttacatataagcatacataagtataaaaccatgcataatcaaatacattgttgctattatttgaacaaacttttatgatagatcacttaagaataagataaataaaagcttttacttaccttcacttactccttctctaatgcactatctttccttatgtagatctaagatttttacctagagaattcctttctcttcgaagagcttcttttaacatttcttgcaaggcaggtctactggcaacaaactccctccatgtttgctgagaaagtctttatttctccttcactttcaaaggaaaaatttcacaggatacagaattttagattggtggtctttttctctcaacactttaaatatttcagtgtactctcttcttgcttgcatggtgtctgagaagtcagatgtaattcttacctttgctcctctatgggtaagatttttttccctgtagcttctttcaagatattttctttaactttcatttcctacagtttgaatgtgaaatgcctaggtgcagtatttttgttttggtttggttttggtttgttttgttttcggcatttatcgtgtctgttgttctctgagtttcctggatctgtgatttggtgtctgacattaatttagggaatttctcaatcattacttattcaaatatttctgctgttcttttctctctttcttctccttctagtattcccattacctatttgttacactttttgtagttgtcccacagttcttggatgttctgttccattttttttgtcagtcttttctctctttgcattttggttttggaagtttcttttgacataacctcaaggtctgagattctcatccatgtccagtttactaccccattgaaagtattcttcatttctgttatagttgtaaaccaaaaataaaattcaaagccccccacctcatctggatggatccctcctctcagcaagggtatccctgagggactaacttgagggactagttcaggccatgatgaggggcaggggtcagacatacttcattataccctcttcccttttggaattactgatagaacatactcttcaagtctgatgagaaacgtgtacaatctattctctctgaagcctgctacctggagccttcatctgcatgataaaactttggtctccacaataccctatcattgtaacccagacatttctttctattgattcaggatcttgagataataacgtacctctttgaactaattgcccatcagaaaattttaaaatctacctataacctagaagccctcgccctttgagttgtcctgccttttcagaccaaacaagtatatcttacatgtatttgattgatgtcttacgtctcctttaagtatataaaactaggctgtgcctcaaccatcttgggcatatgttctcaggatctcctgggggctgtgtcacgggccactggtcactcatatttggctcagataaatctcttcaaatattatagaatttgacgctttttatcgacatagtgttgttgattgctagcatttctttttgagtttttcttagaatgtccatctctctgcttacattattcatctattcttgcatattgtctaatttttccactgtaactcatagcatattaattatggttgtttgttttaaattcctggtctgataattccaacttctctgccatatctgagtctgattctgatgctttgtattttcaaactttttttttttttttttgccttttagcataccttgtaatattttgttgaaagccagacatgatgtactgggtgaaaggaactgtgggccaggcacagtggctcacacctgtaatcccagcactttgggaagccatggtgggcggatcccttgaggttaggagtttgagaccagcctggccaacatggtgaaacgctgtctctactaaaaataaaaaaaaaatcagcctggcatggtggctcatgcctgtaatcccagctactccggaggctgaggcgggagaatcactggaacccaggaggcagaggttgtagtgagcctaggtcgcgccactgcactccagcctgggtgatagagtgagactctgtctcaaaaaaataaattaaaaaaataaataaaaggaactgtggcaagtaggcctttagtgatgtgatggtaaggtgtgggggcagggaaatattctctagtcctctgattaggtctcagtcttttagtgagcctgtgcccttggactgtgaagtaccctcagttcctcccctcccctccccctactctagatgggaccggatgtctggaggggactggagtcacgtatttcccttcccccatgtggatggctagagcaggctgcagttgagtgttacccttaccccaggttgttaggctctgataaaaccccagtaggtcaggctcgtggttactttgctactctctctgccagaagtctgaggacatattttttaatagtcactgtgagaacctgatggagatcgtggaggtaaaattcacttaagtgcaggctcgccgcccaacccccctcatccactttgactgggccgtctacagttttaaaaggcattaaaattttttttgttcttttttagaagtggggtcttgttacattgcccagactggattcaaactcctgggcttaagcagtcctcccacctcagcctctcaagtagctggcattactgtgtcctgagacctcaagagtttttatccctcaggcatatccacattgagcctccagcattccaattacagtccagagttttctacctcagtactggttcccacagaggtttctgctccagtaaattgtgattctctgtatgttcctgcttgtctgtctaattttggggacagtgatttgccctgtgacttcacttctctgacagatctaagaagagttcttgatttttcagtttgttctttttttttttttttttttgagagggagtcttgctctgtcgcccaggctggagtggcgtgatctcggctgactgcaagctccacctcccggcttcacgccgttctcgtacctcagcctccccagtagctgggactactggtgcccgccaccacgcccagctaattttttgtattttttttgtatgtttagtagagacagggtttcaccatgttagccaggatggtctcgatctcctgatctcatgatctgcccgcctcggcctcccaaagtgctgggattacaggcttgagccactgagcccggccaatctttttttattttttcttttttacttcccaaactgttttttgtttgtttgagatggagtctcactctgtcgcccaggctggagtgcaatggtgcgatctcagctcattgcaacctctgcctcctgggttcaagtgattctcctgtctcagcctcccaagtagatggaactacaggtgcacaccaccacgcctggctaatttttgtatttttagtaaagatggggtttcactatattggtcaggctggtcttgaactcctgacctcaggttatccacccacctcagcctcccaaagtgctgagattacaggcgtgagccactgccctggcctccaaactgttttttaaagtagttgtatatttttcttttttaccaggagtcttggagagttctagtacctttacatgcttatcaccctcgatatggtctgtcttttaaattttagctatcctaatagctgtgtagtagtatctcattgtgattttgatttgcatttccctaatgattaataatgttgaacatcttttcttcacttatttgccatccatatatctggtgaactacctattcaagccttttgtccatttttagtttctcttattactgaattttgagagttttaaaagtatgtgctggataccagacctttatcagatatatgattgccaaatgttttctatttctctgtggattttattcttttaaaagtgtctttcaaagagcaaaagttttaaattctgattaagtcctatttatcagtttttgcttctatggattatgcattggtattgtatctaagaagtcttggcctaatccaaggccacacaggtttcttttctactgtattttcctctagaagcattatcatttcagattttatatttagggctatgatccactttgagttaatttttgtatgggtgtgaagtatttgttaaaaagttttgctcgtttgcacatggatatgcaattttttttagcatcatttgttgaaaagactatcctttctccactgaattgccttgttgaaaatcagttgtccatgtaggaatgggcctatttctggactctattctgtccaattgacgtatttgtccattttgataccaataccgcattttcttgattactgtagctttgtaagtcttgaaatctgatagtgttagtgctccaactttgttcttctttttcaaagttattttggctctatactggatctttgtattttcttttgaactttggtatcagcttgtcaatttctataacaaaccctgttgggattttgattgagattgcattgactctacagataaatttggagacaatattgagccttttgactaatgaacgtggtatgtctctccatttattttggatttcctttatctcagaaatgctttataacagtggtcctcaacctttttggcaccaggggccggtttcatgaaagacagtttctccataggcccaggtgtcatggctgggagatggtttcaggatgattcaaacacattacattcattgcacagtttatttctattattattacattataatatataataattaatgtagaatcagtaggagccctgagcttgttttcctgcaactagagggtcccatctgggagtgatgggagtcagtaacaaatcatcaggcattggattctcataagtagcgtgcaacctagatccctcgcatgcacagttcacgaaaaggtttgcactcctatgataatctaatgttgctgctcatctgataggaggcagagctccggcagtaatgcgagcaatggggagtggctgtaagtacagatgaagattcgcttgctctcttgcccacccactgctcatctcctgctgtgcagcccagttcctaacaggccacggactggtaccagcccgtggcctgggggttggggacccctactttatagtttttagggtatagttcttgcacatctcgtgtcaagcttgtcactaaatattttatttttgatgttttcataaatataatgttttaaaatttagtttcttattgtatattgctaatatatagaaataagattgatatttgtatattgatcttatattctgcaacattgctaaactcatttattagttctggtaattttcctttttattctatcagtttttctacgctgatggtcctgtcgtctgtgaataaagacattttcacttctttattttcagtctggattcctttgatttctttttgcttgctttattgcactggctaaaagtgccaatatggtgtgttttgtcacatgaaagctttaaatttttaattatacttgaatttgtccatcttttcctttatgggtttgtgaattttgcattctgtttaagaaattatgtatgccccacatatatgaagatattcttctccattttcttctaaaagttacaacatttgccttccacatttgggtcttaaattaatctaagattaatttttgtgtctaggttaacacacacacacacacacacacacacacacacacacacacacacacacacacacacacacacacacagattgccaatcaacccagtatcatgcattgtctgtcctttccccagtggtttgtactgatacatctgacatatgtcatggacccatatccatatgaattggtttctaagccctccaattttattaagtttgtttgcttgtctattcttaaatcagtattatctgttttcatttattactatagcatcatgatatgtcacgatgaaatataagcagggtaagttctaatttttcttcagatttgtcctatttgcagacttttaattttccatatgaactttatgaccactttttctagctctatgaaaaggtgattgtattttgattggaattgtgttgaatttatacattaatttgaggacagaaatttttcacaaaaattttagattcagaaggtacatgtgcaggtttgttacatgtgtattttgcataatgctggggtctgggcttctactgaccttgtcacccaaatagtgaacatagtactcaataggtagcttttcaaccctcgccttcctccctttctccccctttttggagtcctcagtgtctataatttccatctttatgtatgtgtgtacgttttgtttagctcccacttacaagtgacaatatgtggtatttgattttctgtttctgcatcaattcacttaagataatggcctctagctgcatccatgttgctgcataggacatgatttcactcttttatttatggctgcagagtattccatggtgtatatgtaccacactttcttgcactgatatgtttataaaagtggtattcacaataaccacctcatagaatcaacctaggtgcccatcaacagtggactggataaagaaaatgtagatttcttttcctttgggtagatacccaataatgggattgctgggttaaatggcagttctatttttagttatttgagaaatctccaaactgctttccacaggagctgaactaatttacattcccaccaacagtgtataagcattcccttttctctgcatccttgccagcatctgttattttttgactttttaatagccattctgactggcgtgagatgatatcttatttgattttaatttgccttcctgtgacaattagtgatgctgagcattttttcatgtttgttggctgcttttatgtctgtctgcttttgagaagtgtctgttcatgttctttgcccactttcgaatgttgttgttgttgttgttgttgttgatttaagtttagattctgtatattagtcctttagtcaggttcatagtttgcaaatattatctcccattctgtgggttgtctgtttactccattgacagtttcttttgctgtgcagaagctctttagtttgattaagtcccgtttgtcaatttttggttttgttacatttgcttttgaggtcttcaatataaattctttgcctaggcaaatgtccagaagaatttttcctaggttttcatagttttaggtcttacatttaagcctttcttttttttttttttagagacggagtctcactctgtcacccaggctggagtacagtggcatgatctcagctcaccgtaacctccgcctctcgggctcaagcagttctcctacctcagcctcctgagtagctgggattaaaggcacatgccaccatgcccagctaacttttctatttttgtggagacggagtttcaccatgttggccaggctggttttgaactcctggcctcaggtgatctgcccacctctgcctcccagagtgttgggattataggagtgagccactgagcccagccacatttaagtctttaatccatttttagttcatttttgtatataatgagagttagggatccaattcatgtctagccagttttcccagcaccatttattgaagagggtgtcctttctctattgtttatttttgtcagctttgtcaaagatcagttggttgtgggtatgtggctttatttctgagttctctattcttttccattgatctattagtacgtgcctattttttgtacaagtaccatgctgttttggttactatagccttgtagtattgtttgaagttgggtaatgtgatggctctggctttgttatttttgcttaggtttactttggcttttgaggctcttttttggttccatatgaattttagaaatgtgttttttctaattctgtgaaaaaaatgacattggtaatttgataggaattgcattgaatctgtagattgctttgggcagtatggatattttaatgatgttgattcttacaatccatgagcatgggatgtttttccatttgcttgtgtcatctatgatttctttcagcagtgtttcatagttctacttgtaggggtatctcaccctttgattaggtgtattcctaggtattttattttttgtgtctattgtaaatgggatttcattcttcattggttctcagcttgaatgttattggtgtatagaaatgctactaatatttgtgcagtgattttgtatcctgaaactttactgaagtcatttttcatgtctaggagtctattggaggaacctttggagttttttaggtgtagaatcacattattggcaaacagagatgatttgactgcctttttccctatttggatgccttttatttctttctcttgcttgattgccctggctaggacttccaatactatattgaatagaagtggagagagcggacatacttgtcttgttgcagttattaggggaaatgctgccaacttttgtcttcctgatgtaagcctttagcactataaactttcctctgaacactgcttttactgtatcccacaggttttggtatgttgtgtctctgttttcatttgtttcaaataattttttgctttaatttcattgtttacctaaaagtcattcaggagcaagttgtttagtttccatgtatttgtgtggttttgtgagttcctcttggtactggtttctaattttattccactgtggtccaagaagatgcttagtagaattttgatatttttgaatttattgagacttatgactgagcacgtggtcaatcttagagactattccatgtgcagatgagaaggatgtatattctgtggttattgggtggagtattctgtagatgtctattaggtccatttggtcagaagtccaacttaagtgcagagtttccttgttagttttctgcctcagtgatctgtctagtcctgtcaatgggatgttgaagtcctccactattattgtatggccatctatgtcttttcttaggtctagtagtaattgttttataaatctgggtgctctgatgttgagtgcatatatatttaggatagttaaatcttcttgttgaattgaacgcctcatcattatatagtgcccttctttgtccttttttaatgtcgttggtttaaagttgttgttggttttaatgttgttggttttatctgatacaaaaatagctacctctgctctattttgttttccatttgcatgatagatctttctccatccctttactttgggcctatcaatgtcattacatgtgaaatgggcctcttgaaaacaggagaaggttgggtcttgtattttttttttttaatctaatttgccattttatgtcttctatatggagcgttaaggccatttatattcaaggttagtattgatatgtgaggttttgttcctattgtagtgttgttagcaagttgctttgtagtatcaattgtgtagttgcttcataaggctctcggctttatacttatgtgtgcttttgtggtagcaagtattgttctttcatttccatgtttagaactcctttaaatatttcttgtagactggtctggtggtgattaattcccttagcatttgcttgtctggtaaagactcaccttcgtttatgaagcttagtttggtggggtatgaaattcttggcttggatttattttctttaagaaggctaaaaataggtctccaatctaggaggtctactgttagtctgatgggattccctttacaggtaatttggcccttttctctagctgcttttaaaatttttccttatgttttgacctcagatagtctgatgactatttgccatgggagtggttgtcttgtatagcattctgcagaagttctctgaatttcttgtatctgcatgttgacctctctagtgagattggggacatttttctgaattatagcctcaaatgttttccaaattgcttgctttttctccttctctctctcgaatgccagtaagtcataggttgggtcactttacataatcccatatttctcaaaggttttattcatttttaaaattatttttccttattttgtgtgactgggttaacttggaagaccagtctttgacctctgaaattctttcttctacttgatctagtctattgtcaaggcttcaaactatattttgaaattcctgtagtgaacttttcaattccaaaagttctgtttggttctttcttaatatatctatttcatctatttcatctgtcatttcctggatcatttttctgttttatttgtgctggatttcaactttctcttggatattgttgagtttccttgcaatccatattttgaattctttatctgtcatttcagacatttcaatctggttaggatccattgctagggagctagtgtgatcctttgcaggtgagaaaacactctggttttctgtactgccagagttcttgtgctgattcctgattccttctcatctgaggctgttgctgctttttttttttttttttttgggtttgctaccatttcagagggctttctaaaaatttgttattcttttttcctttgagggtatgactgtggtgtatgttgtgtgtgattgattggcttcatttctgggtgctttcagggggcaaagctctgtacagtttccttggttgcagataggttctgtgctgtggctttgtcagatgctgcttattgtagcaatgcatttttgtttggtggtgcagttcaggctgcagtacagtagatggtgcttaagagtagcagccagtaggtaggttggtgtccaggtggacgcacctgccctgatggtggtggcaggaagagatgatggtgtgctaaagtcttgggggaccaggcttggtggctcacacctgtaatcccatattttaggaggccaaggtaggagaattacttgaggccaggagttcaaagccagcctggttaacatagtgagactgaatctctacgaaagaaaaatttaaaaattagctgagtgtggtagtgtgcacctgtagttccagatactggggaggctgaggtgggaggattgcttcaacccaggagttcaagactgcagtgaaccatgaccatatgactgcattccagtctgggcaacagatcgagactctatctcaaataaaaaaatgaagtctcagaggcgggtttggggagtgcaccagcttcttgtcttagaccagcaggaatccatctattttcttatcatgtcactctcaagggctcacgacctgtttgtaaaggttttgtcctttggttctatgccactgtgtggctgtgggccgtgaatccacctttctgatggctaccattagagtgggggtcagagcagagcctattcccacagtccagggagggtaactccgaggtctgtccttcattgctagggcactgccattctgtttagggagggggagttgggccttacactttgtgcaagcacaagcagacacgggcttgctttcagtggggttggagctgtgggaaaagtgtgacaagcactttctttcagtgtgagctcactttcagcaggggtagagctgctagaaaagcatgaaaagtgctttctttcagtgtgctctgactttcattggaggtagagcttccagaaaagtgtgaaaattgctttctttcagtgcacattcactttcagggggaatggagccaccggaaaagtgtgaacagtgctttctttcagtgcatgctcatggggccctggtggggagatctgctgctgcatctccaacagttactgggagaggggtgagagatgacccgtctctccatatctgttcccaggcatcagtaatatccccttcagcagttggtaccacacccatcattcctttgtcccaaagaatgctttggtgggctgtgctcccctctcccttaggggcagcccacaatgaaattagatctccaggggacctactggtcccctgtgcttgccaaaattatagtgggttctggggtatgtttgtgggttgtctggtggtgcagtggctcaaatgcagaggatccctgggcacggcagtgacaccacatgtgcacagctggtgtggtaccctccatctcagtttcagtctgagagttgtgtggcatggctgcacaagctggccacctgattttggggacataatttctgtcactttgaaatagaaacttctcatccataaatataatgtatcttgttttataatactttatagttttattgttattgtagctggtatatttactttaaaattacattttctagttggtggtatgtatgaatgctattgttttcgtttgtttgtttgttttttgtttttgatggaatcttgctctgtcgcccaggctggagtgcaatggagcgatctccgctcactacagcctccgccacccgggttcaaacaattctctgcctcagcctcccgagtagctggaattacaggtgcccaccaccacgcccggctgatttttgtatttttagtagatacggggtttcaccatcttgccaggctggtcttggactcctgaccttgtgatccacccgattatgttttgtatattgatctcattttattttttgaattctcagagtctgtagattcttttggattttaattttggaccatattatataaactataaataatgacagatttgcttcttcctttctaatccttatgatttttttttctatttttattatattggctagggcctacaatgcaacatgtgagtagtaatagcagatctccttgtctttttccttaccttacaaaagatatttttactaagtacttagcttattatgagtttttggtagatgcagatattttctttaggattttcacatctttattcataaaggagataggtctatactttttctttctcataccacctttgtccatgtcaaatgtgtgttttataattgcttcataagatgagtttcagaacattcactgtttcttaaagcagcttgtaaaatgtaggtattgtcagtttttttaaggttttgtgtaagttgtctgtaaaaccatatggcccttccttttttcagtgggtagatttttaatgattcacttcctctaatacattttattccagatttctatttcttcttgagttggttttgaaaattatgtagcttctagaaactttcccatttcacctaattttaaattttttataacctttttagtcctgttactgttgatttgtaccttttcaaaaaatcaattttactagagttgttttttagatttttttaaacaaccaaattttaacttgttaaccctctttttaaactttgttttctatttcattaattcatcaatttgtattcttatttttatcatgttgttctttgtactttttctgtgtttattttctaacttcttgacttgaatatgtgtttcactgattttcagtgtttcttttctaagaaatgcacttaaggctttaatttgccttctgagtattactttagctgtggtgtatttagtgtttattatcctccatatataaatattttctagtattatttcttttttgaccaattagttatttaaaagtttgttttgacatttccatatgtgtatgaagttactctcatttggttcttaatttctctttttattacgtttagttagagaacattgtctgcatcttcttaattctttgatatttaatgagacttgcttcataaacctgggaattaagtcttaatttctgcaatgcatgtatttttctcttacttttgaagtttaaacgggtacataattctagatttaactattttcctttgatcttttgaagatactctattgtcttttgcctccattgttggtacgtctcttgttaatataattgttcctttgtagtcataagcctttattccctctggctgtctttctttgtttttggtgttctgcagttttattacaatgcatcttgggactatttataattcttcagtttgagaattattctgagccattatctcttcaaataacttctcttgttcattttgcctgttttccttctcaaactctcaacctgttcttgttatctcttaatatcctgtcaaactcctcttttttctccatgtcttttgatctttcattcttttcatttatttttcattctgtgctgctacatttctggaattttccttaaatctcccatctagttcattgattcagtgactctgccttcttattctttaagtactatttaattgttgtgtttcatgtttccatccttttccgtagcatcttgttcttttcttatggcttctctgtgttttatctctttaataattttaaacatcataatttcatggttcattactgatttttgttctattgtcccaaattcatggaatgccaatttttctgttatatctgctgacttagggtggattgtttccttttgttttctgagctcatcttaaattggactttcttcctccacttcattgttcctttgttgcttgggttgaccatttagagtagtttttaaaaaatcttttattttgaactaattgtagacttacagaaaatttaccaaactagagttcccatatttccctcacccagctttttctatgttaacatcttaccacagtgtaattattaaacccaaacaattaacactgggacagttctacagactaaaaacttcatttgaattttaccaatttttcactgtcatttttctgtcccaggatcctatccaggatcccacattgcatttagtagttgtttcatgttagtcttctgtggtctgtaacagttcctcaacctttctttgtcttttatgaccttgatactttttaagaatagtggtcaattattttgtagaatgttgttcaatttggagttgtctgatgttttctcatagttggactgagattatacacttttggaaagaataccacagaaatgatgttgtctccttcttagaacatcatatcaagtggttcatgatgtcagtatgtcttactactggtgatgttggccttgatcacttgattcaggtaatgtctgccagctttctccattggaaagttactatctttccttttgcatttaataaataccttgaaagagacactttgagactatgcaaaccctactttttctcaaactcacctgctaattttagcatctggcaatagaactctttgagtaattttgattttacctttccaggctagcttataaactggtctaatttcatgttaattttgatgttaattaattgccttggaacatggattagtcaattttttttgttataaaggaatacctgaggctgggtaatgtataaagaaaaaatgttaattttggattatggatcttcagactgtacacgaagtgtggtgctagcatctgcctctggtgagagctcaggaagcttacaatcagggcagaaagcaaagtggggagctggcatattacatggtaagagggagcaagagagagagtaaggaggtgtcaacttcttttaaacaagcagatctcatgtgatctcagagcgagagctcactcatcactgaggggatggcgctgagccattcatgagggatctgcctccatgatccaaatccctcccaccaggccccacctccaacgctggggattacctttcaatgtgagatttggaggggacaaacatgtgaactgtatcagagctttatatagtaagtgggcaaaataaatttatactccaaattcttattaggtggaatattggctttgatttctatcagataacttattttttttatacctagagactcagcagagaaaagcctcattgtcatctctcttgtccaatgggtagaatttattaattctttcacttcacttgcagccttttacagttctagctttatgcataggtttaatgtgtaggagttcccaattgctactctcctggactggaggtcttgtcgtttgtgccctggtgagtgttaaaaaatctaagctcttacctgctaaagggtttgatcccacttcctccccaccccaactacctctcatcctgctgccacctattagcttgttcatcttcctctctggctgtcagctacctcttcgcgttggtacctggggacatttctctctgttttcacaagctcagccaggagtgtgagttttaattgctgcctagtctaccattttgccatgcacaatctctctcccatgccataagactctctaaaattacactggggaaaatactgactagacacgttattattagggaatgtcactttattattaatacctatgctaaactggatttggctgtgatcgtataggcctagttaaaatcagttccactatttaaaaatcttaatcacgcttaggcttctctctttctatttttgaagcacatccattcttataaccttgaattttatgggacgctagaaaaaattattggcattttagaataaataaatcatataatgttgtgccaaaacagatagagtgtttcttatgtttctaaagagtggaaaaaggaccaactctttttctggggttttatatatacatatatatttatattgtgtttattttatttctttttccatgattatattcttgtggaaatgaggaaatcattaacagtgaaactactgtttcatccaaaatacagtgttctaatggtctgttttctaaatgaagcttctatgaataaaagcaaggccgctatatagccatttagttgctaacaaatgacctggttagtgccacccatgatttcttctttaattagattgcaaattttgtgtttaaaaatgggagcagtaagtaaatgctaatttgtagttcctcagagggagaattgtgatgtaaaaattaggatataaaatgagaggataccgcagggcaggagggtaatggcacttgggccaccatagggcaggccctgccaggctgcttttcattcaagtaaattttgcaactcaaagtactgggtatggaaggcgtgccacatagtacagtgtttaatcatgtaagtttattctttcttcattcaataaacatatattgtgcatgtgctctgtattgggtcccatggtggatgacagaggctcagaggtgaatgagctgccttttgggagtgccagcctcatctgtggccttggactgctggttctgtgctgccaatctgggtcactctcttcccacaccattttggaggggtctctcctttgctgtccagtttcttctgcctgctcctgaagacatgaactaaattatatttcttctcttaagatgttccttaccactgcagctcagagtaatccttgcctctttgaactcattttatttatggctggtgctacccagcatatctttttattcccacatgcatgttagttggagaatagatggatgaatgaatgaatgaatgaatgaatgaacgaacaaaggtggtgccttttgtttggattcaattttcactcacttaataggatcatattgacagggcattcctagacttattttgacctttcttgaaggatgattcattctaccacttactaataattatcataaaagctaacatttatatgcttgctgcttaccatgtgacaaatgttgcactaaatgctttctacatattaactcatttactcctcacagcaatcctacaaagtgggcactattattattcccattttgcagatgaggaaactaagaagcagagaggttaaggaatgtacccagaattacatattaagttgcagagctgggatttgcatcaggcagtctagcaatttcatcatgagttatgatttagaatcaaactagctaaggttgacaattcattctgcctctctaatgcttcaggttcatcatctgtgaaatgagaatcattcaatggcttactgggggcgttagatgaattaacatatgctaaacactaagccagcaaatatccatgacattagttccatccatttcttcttaccactggccacatggaacttacactctgggtctagaaagcatgtatgtgcccctggatggctcagcagctgtctccaccaactttgagatcttggctgtgattaaaatctttttccttgactctgccttttctggaagactgtcttttggaatgggggcagttggggtaggattaaaaaacactttctgagtaaataccccttcagttcttcttctcactattgtatgtatttttatatttatctattttgccttgtttcagaaatggatttaaggtaagctagaaagatgtagacagttctgtaggataaaatgaatatgcaaatgctaaaaataaaagaaaaaatataagtaagaaagaacaggggagccaggagtggggctggcatacagagtatatttacaggctctgaagttagaggcatttactagcagtcagccacaggcctggctctgagcttcctagaagtcagtgcaaaataggagaccatgatccgttcatggtgttcataaagtaactataagctgggtgtggtggctcatgcctgtagtctcagcactgtggcaggccaaggctggtggaccacttgagcccaggaatttctgaccaacctgggcaacatggtgaaaccccatctctactagaaatataaaaattagctggacatggtggtgcacacctgtggtccctgctactagggaggctgaggtgggaggatcacctgaacctggggaggtcgaggctgcagggagctgtgatcacaccactatactcttaagttggacaacagagtgagaccctgtctcaaaaaacaagcaaacaaacaaaaaacaaaacccaaaacacaaaaaacataaagcaacaataagccaagttgcttaggaaaagggatcctaatgcagagtgcaagaaagactttctccactggccactcacagaaaggactctctggtaggtgagtggtggtctcagtagcgtgccccaggatacccagggataaggtccaggtggctgtttctgacagtattccctagaagaaaataatatcattccatcagaatactgttcagtcaaattaattctgccagaggcatcatgtgccatagcccaggtgtccaactttctgaggtccagcttaacactggggtttgaagctgcctcatagcactggggtgtgaaggagaagaaagtgcaagaaggcaggacttaggagagtacatcaataatcaattgccagaattttgatgtgtaataaatgacctgaaaatatctgtcacgcaaaaaaacaaaaaaacaaaacagcaacaacaacaaaaaaaaccacacacacacacatttatttagcttacaggtccgtgggttggctgagggttcgttgatctgagctgggcccagctgggatggctctgttccatatgtctgtcattctccttcaaggagcagcgggctaacccaagtatgtcgttctcatggcgatggcagaagtgcagtcagagtgggaaacaagaagacctcttgaggcctaggcgcagaactggcacactttgacttccacgtcattctcttggccagaacaagtcctgtggctgaccccattgtcaaagagcaggaaaattgtgcccctttagagagtgcgacagcaaagcgacacaggaaagggcatagatagtgagagggaagtattgaaggcaatgatgcagtatcccacagagggaatggaaatgactttgagaaaagctcactgccccttgaggcacagaggcccctgcactggttgtatctgctgccaccatgcaggtttaattctctgctgcaggaggcttgggcatgaagtggctctggttgtggctagttaccattgcgacaaatgagctcagtacaaattggaccctgcgagtcaccattctgtaacctgggtagaactttgtgccagcgcctgctagagttgcacactccctccctaagctggaatatggctgggcccctgaagtggcagggaagttagggttataactgacaaccagctcccccattttgtttgatcttaattaattcgtgctcattttcccttatattttataagtagaaatgtgaaacacttactaggtgagcatatttactttattttttgatttagagccacctaagttttagagatgaagctatcagcatatggatttcttccattactttgaaaactgctatatttggtactgatgttctgtggttacatgctgggatccattacatagaatttaagcacagaatgtttaaaacaaggagccaagaacaagttctcattacattatctggattgaaaatgatttcttactgacattgtaaagtttcaaaattccagccactgtcaaaacgtagccgggtaacttgcctagatcgtgtctatgacttctaattcagatttgattctcagcccagtactaccctctcccaagctcagaattcttcatagaagacccaaaacaaataaaaaaaataagccacaacaataaaatgtaagaaattctcctacttcatattctgggaaggaagtaaatcattttattcattgatggacttatatttctgcctttttgatttatttcctggcatgagagacctagttgccttaatgactatttgtcaattgagcacaagcccaaaagtctaccctggggcttccatgtgagtcagtggtcccagggaagagccactgctaagggttgtgctggttgtgaactacacaactctggaacactgcatggagagcctctcttggaattcctttgtcagtggttggggtattggcacaaggctcccagcttttactctgcccctcatcctcttcttttcctaccaaacacctatcccaaatttggcttcttggtctctaaatcaaaagctggtctttcttcctccctcccaccctccttccctaaataaatgtgccctcttttcatagtgatttggcacatttatttagaatggatacaactaggtccctcctttccttgaccactctccctctgtctacacacacggacacatacacatgcatgccatctgtgacagagcctgtggaatttgtgaaccatagccacacaccaatgcccaggactgttctagagacctctttgtaaagttgcatgagcagagaaaaactaaaccacgcagtacaggagaatccatacagattctgaaaagttagttttattgtgtgaaaagttagtttttgtttgtttgttgtaggaaactagttacgttattgtaaatcaaaagtatctgagaaaggtctcaatcaatttagaaagtttattttgccagggttagggacatgcccatgacagagcctgaggaggtcccgagacatgtgcccaacgtagatcagggcacagcttggtttatgtattttagggggacttcagacttcaataaatatatgtaagatgtacattggtttggtccaggaaggtgggacaatttgaaggggtcgggggtggggcaggctttcgggtcataggtagatttaaagatgttctgattagcaatgggttgaaagagttattaccaatagaaaggattgtctgtgtcattataaggggttgtgaagaccaaggttttactatgcagatgaagcctccaggtaacaggcttcagagagaatagattgtacatgtttctaatggacttaaaaagtctgttctatcagtaattccacaagggaggagggtataatgaagcatgtctggctcccacttcccatcatggcttgaactagtttttcaggttaactttggaatgcccttggttgagaggaggggtccattcagatggttggggggccttagaattttcattatggtcacaacaaaatatatcagagtctcagcaggagcaagccattttgagaagcaagcagagaagaataaagaaagatgtgttagaacttacaaaacacattttctgaattaaaaattagaggcactaatagaaaactggacactgcagaaacttggtaataaaccagagaactatctttagaaataccaccaagagagcaaaattagagagggattgaaacaatgacaaagaagagagcagaaacgaaggtagagagagaactaaataaatgtagctaaagtgataatcaaagatcgtttaaaaaaatcattttctaagctaagtaaagtatttgtaaattgagagaattcactctgatccctgtaaaatatacgaaaagagatcattaaatataccttggtaaaaatgtgaaaggtcacatagaagactcttataagaatcaaagcaaacttatccaaaacaacgcttaaaaataccaccatcaccagcagaaccaatgccctaaaacccaaaaagatatgacctcaggcaatacacagaggcagtggttaaatcttcagtgctttgagggtaaacaagttgttttttatgcatggaacaatagaaatgttttttaaacctttaagaaaacaaaaaatatctagtttctttagtaaattgctcaaagtaatatattaccttaataacttaatccagaatatgatgaaaaaatcaaaattaagaactcaggaggacatcatatctttaaaaattggagcagcattggacattaaaacaggttttatacacacacacacacacacacacacacacacacacttacatatgtgaattcaaagtgaaaacattgtttcaaagaggtgaatgacatgattagaaaaattaaaaaggtagatgaaatgggttatgccacagataaaataaccgaaactcagaaagagagtataaggagactaagggcaaaattcctcatattttatctgaatgtgaaatcatatttcatccatttctttgataattaggtatatataggtttaagatattttagggcaatttcaagttaatcaagaataagattctaaatggaattgcagaacctaagagcaaaccaaatatggtaaatccttaatgctgtcaataggttctcagaaactgactttaggtgaatgacatataatgaaaccaattttcccttaggctaattgagataaacgaaagttaagttcctatagcatatttctgttcacaaaaaaatcaccaaacttctaaataaagacccaaacacttataatatcaagcattgaaataaatgggagttatacatacatttaagaaagatgaacagactgggtgcagtgactcatgcctgtaatcccagcatgttgggaggccgaagcaggtggatcacctaaggtcaggagttcgagaccagcctggccaacatggtgaaaccccatctctacgaaaaatacaaaaaattagctgggtgtggtggcgggcgcctgtaattccagctactcgggagactgaggcaggagaatcgcttaaacccgggaggcggaggttacagtgagctgagatcacaccattgcactccagcctgggcaacaagagtaaaactctgtctcaaaaaaaaaaattaataaaaacaagacaatgatttacccaattttggtgaatcagtgagtggcagtggccatggtagtgatgggttaaatcagggaataaatgtttgcagagcgaacattgtaaggagcatcttttcccaccttgcagttcaaaaccaaaaaatcacaagtagagcaggcttgctgagcgcttttgtcccatgtcctttattgtcatagacttgatgagtttttattttatcctaatttgtattcatttgttcattcattttccaatgtgcttattccagttcaaggtcatgggtggctggagcctgtcccagcagctcagggtacaaggtgggaaccagccctggacaggacaccatcccatcgcagggtgcactcacacatccacactcagtcacactgggaccatatagacatgccagctcacctcatgtgcacagctttgggatgtgagaagaaaccagagaaaacccacgcagacatggagagaaagtacaaacttcatgcagacagtggctccagcctggagccatttttttttccccatcaacattatcataaaatgatgttgaacgaggtgatgttattcaagaacctgctatatttaggatgtattgcaaaagacaagaagcaatcaatataaggtaatggtaacaatacatgaaaaactgaaaacacaaaataagatgacaggaggaaaaaaaatcaagagaaatcctcaccataaatgtgaactcttgattgcccttgaaccatcatgacacattccacctgctccagattggcatatggtcacctctcttttactttctcatttaattcccatttgccatattatcttgaattcctcttggagatttgtcagtatattcttgagacctgttctcttttcctttgcccttcattgtccaggaaccccagggatgcttattttgtctggagagggccagaccactgccaaacactgctgctgtggcttcttgttgtcaccaggctgctgtggaagacaggttctgccaggctggtggacactaccaggatgactttaccgggcagaaggtcatgggctgggttttgctgttgttttaagttgagagagacatgaacattctatatgctgaaaggaaaggaccaataaggtccaaaaggaaagggccaatagaaatcaaagtcacagatgacaaactggacaactgatggatcagtgagtagctgaggatgaagaagcagttaaggagggaatcaaggcctagttgtacctgtttccactctccacaatggatatttcagactttctcactcttaagctcctaacttcaccattttcctccaatttataacagaaaacctcatctccaggttaatagagcatatagagatcctgagatgtaaaccacacccatgcccccacatccacaacttgccattcctttttcatctcggtagaaaaggtgtccctcctgctgtccaaagctggcttccatgatggccctgtctccctaacactcaacaagaggcttagagtccatccgaggcccagcacattcaattctagtttatgcctctgagctgcaacctcagcccattctcttcatctcagatgcactcccgtgcctacctctgcattgcttcctgagtggtggggcttctaactctctgctcatattgctgtcttgctcaacacccttcaagagattccgttcaccaaaagaagaaaacctgggtatcctacatggcgtacacatgcatctctcatgagtgggccccgcctgccagctctctaatttatctcttgctttgttttcactatattctaatcattctatgaatcctgaacattgtggttcaattcttggctccaccacttactattaatagtactgtgcccttgggcaatctgttaaagctctctgggccttagttcctcatcagtaaaatgggaaccaagttcctactgaaaggattgtcatgagggttaaatgagtctatgtgtgtgaagcagatcaatgtttgacataccctgagctcttgataatgtctgtgcctgttattaacactttgtacagcttctcagatgtattataccatcttcttgccctctttttttttttttttttttttgagatagagtcttgcttcgttgtcgcccaggctggagtgcagtgacacaatctcagcttactgcaacctccgcctcccgggttcaagcaattctcctgcctcagcctccgaagtatctgggactacaggtgtgcaccatcatgcccggctaatttttttttatttttagtagagatggggtttcaccatgttggccaggctagtctcaaactcctgacctcaagtgatccacctgcctcagcatcccaaagtgctgggattacaggtgcgatccactgcacctggctcttcttgccctctttgaatctttgaggatatgattctttctcccattcctctcagcctccttcccttactcagctcccacttctctggttggcagattgcctttcatcttcaagatctgctctgctaccacctctgctgtgaagctttcctggatttctcgctatatgtatacacatgtcagactggatgaggggtactttctcggagcttttggacatatctttattgtagcactttttctgcttccttgacttggctttccctctagtctgtgattaattctaggatgtagatattgagggttgggggtcaaatctggtccattcctctattattctccatcatttgacataaagttaatatttaatcagtgtttattgaatgaatgaatgaatggattcatggacaagggatgtgtgcagacagaacacaatagaagaaatatttcttaacaaataaggggaagagatgttgaagtttattagtaatcaaattattattgattaaaatgagacatcatttttacttgttgaattaggaaacactttttatggccaggcgtggtggttcatgcctataatcccagctttggggaggctgaggcaggcagatggcttgagcccaggagtttgaaaccagcctgggcaaaacaaaaagccaaccccgtctctaccaaaaaaaaaaaaaattgctgggcgtggtggcacatacctcacatacctgcagtccccagatactcgggaggctgaggtgggaggatcacttgatcccaggaggcagaggttgcagtgagctgagattgcaccactccactccagcctgggtgacagagcgagactctgttaaagaaagaaaaaaaaaaaacacttttttttttcttttacttctgtctccatgtttgacaggaaacactttttgaaaggatattccattgctgtgggctcttactcattgctgatggaagggtaaaagcagcttagtactatgtgtcaagacctttttaagtgttagtttcttttaaatttttattttacttttcatttttgagacactttctcactctgtcacccaggctggagtgcagtggtactatcataactcactgaagcctcaaactcctggactcaagcgattctcctgcctctcagcctcccaagtagctgggactgcaggcacacaccacaatgtcgagctaatttttaaaaatgtctgtagagacggggtcttgctatgttgcctaagctggtcaaatgttcctttgttttgcctcactaattgtacttctggaacaccatccgaagggaataattgtaaatacagacaaatgtttatgcatatagatgctcattatggcattatttatataaaaatttggaaaaaaaatgtgtaatatctagtaacagaagtatggtttagcattttggtttcagaatagtctgtaataacatggaaatgtattagttaagtgaaaaagatgaaaatatgttcacacctattaagaaaaagacaaatgcccatgcatagtaaagagactgcagaggagtgtaccaggatgtttacttggttatatttcggtggcaggggtgtgtatggtttttcttttcttttttttccttgcttttgcatattatccaaaatctctataattggaaatgtattacttttataatggagtaaagcccatatatatatatatataccattttgttttcctttgagacatggtcttgttctgtcacccaggctggcatacagcagaacgatcatagctcactacaactttgacctccttggctcaaatgatcctcctacctcagcctcccgagtagctgggattacaggcatgtgctaccatgcctggttaattttttaacgttttggtagagatggagtctcattaggtttcccaggttggccttgaactcttggcttcaagtcaccctcccaccttggcctcccaagttgctagaattacaggcaagaaactctgtgcctggaccaaattttatattttaaagtgtgtgttcaaaaagatttaagaatctgattatattactgataattatttgatatgagtaagtcttgaattactaaattgattacaagcaccaatatggcacagactgtgttttgtattcaaccgttgtgtgatcaataagtacctgtgggtttatttggaggcacccttcatcatgtaaggccccctgattgtcacagagctcaccatggtcttgtaggcctctaaaccatcgggaaccaagtgagagacagttaaaaacaaaaagccaaacaggtgggatttgcttggagacaaataatccctgaacataaagtgggtgttaatgcaaaggcagtggtagaaaacgaagaactctgcttgtaaatgaaatgaatattcactccttctgcttaccttgcaagttaagcaccagtattgagacttcatttgctgttaccagttaccaaaaatgttgacacaatttaaaaaacaaaactaaaaaacccactgttgctttagcttgtttaaatgcatattgtaccaaatcatggaagaattatagatgaacattttaaaggatttctaaaattatacttctatgaagaatagactgttaatggtatacagcaattactcttaactgcatgaaaatatctcattttgtttggctacacttaaacaggcctgaagtctagtgcaccaagacatactgaatttcaaactaaataaattaaaattaccatgtacattccactacatgtcaaaacaggaaaaaccatagtattatagttgatatgaaatgaagattacatacaacagtaatacagagaaaacatgaagctgcttatatttatttggaataagacaacagggtcaatgattttcactgcagatgtacttctttttgagaaaatatatccaaaaatcaatttacaaggcagatgaatttggctgttattatttatagtatgtaaatattatttagtttcaaaaggatttctttaaaccaggcacagtggctcacacctgtaaccccagcactttgggaggccaaagtgagaggatcacttgagcctaggagaccaacctgggcaacatagcaagaccccatctctacaagaaagtttaaaaattagccaagcgtggtagtgcacacctgtggagctagctacttgggaggctaaggtgggaggatcgcttgagctcaggagttcgtggttgcagtgagccatgatcacaccactgcactccagcctgggtgcagagtgagaccctgcctcttaaaaaaaaaaagacttattatttatttcagggttcagtgtccttgcttgtcattaagaacttgacagaaattagaggaatttaaagctatgatgttagatgccactgccaatttaaaatgaccaagataaagatagcatatctttatatgtaatagagagtgaaagagggcatctaattcaatttctaaaaattaagtatttatggagcatttcagatctattcattgtataaaagaaggcacacctggagtttatttctttagcactttagacttactcctgaatatgactgtttaaaacaagcatgccattttcattttatatcctgcagatagattctaaggtttcagagtcatcaaaagcatttcacatttctccaaggtaaacttacttaagagaagtagtgctttcagtttaatacaacttgaaattatctccattgtgagatggtgaaaatagtaaaaattgctattatttattgagcattcatagttcaaggtactatgctgaatgctttttatatcttgctaacttaatcctcatttttcatttattcatcagactacttgttatagagagcttactatgtgccaggggctacttaaggtgtcacagattcaacaatgaacaaaatagacaaaaaccactactctctgtggatcttacactccagtgggggtgggagggagataaagactatcttcaaaataagtaattatataccgttagagtgtgatgaatgacactgaggaaaagaaagcaggaaaagggttaagaagtgccagagttgtagaggaaggggtcacactttttttttttttttttttttgagatggaattttgctcttattgcccaggctggagtgcaatggcgcaatctcagctcactgcaacctctgccttccaggttcaagcgattcttctgcctcagtctcccaagtagctgggactacaggcgtgcgccaccatgcccgactaatttttgtatttttagtagagacggggttttgccatgttggccaggctgatctcgaacccctgacctcaggtgatctgccggcctcagcctcccaaagtgctgggattacaagtgtgagccaccacgcccggccagaggtcacacttttaagaaggttggccagagaaggcctcacagagaagctgacatctaacaagataagatgccctacaggaggtgaaggaacagcctatgtgactgtcttggggaagaacattccattctaggtagagagaacagcaagtacaaaggctctgaagttgaaatgtgcctggcttgttttaggcaggtgtagagggaaagatgggaagggttgtagaggatgaattcctagcgacagcagaggaggggccagatcatgtcaggccttgtaagccatcatgaggcttttgagttctactttgagagagatggcaagccctcacagggttttgaacaggcaaagaacatgatctgacttctgttttaacatatcatcctggcttctataggaaaataaaattctatttcacaagtggtcttgtcccatttcacagataaggaactcagattcagagaagttgagtagtttaccacagttcccatttactggtgaattagtgggactagaattttaatacaagtcaatgtaatttgaaagctcacactttttccagactgcctcccaattgaaaacaagcttgtgacctcagctggagtagttttctgatagtctacagtgaccccttttttctccttttctgtggaattccttggtctctcttgtgaggccaccatgttgcataactccggaagaaaccacttataccacaagtctataactgtgccctctggaggtgggcagtatgaagccaaagtgaagtggccatctatggtggccttgttctccagtgaagttgaagagctttgtacatggcattaaactctagttaggcctgtagcaaaacctgtttggtcagacatttgtgtcggactctctgtgatgtattttgccatctctccttcctctgacacatattctaccagctatctctaccaccctctactgtctggcaatactctagctgcagattcaacaatgaacaaaaccacagtatgacatgctggaatataagtggcaatacggcaagggtttctgttttgtatgggcagcttaggcccacaagtgtaagagaaagcctgagggagggtaggatatgagcaggtgtgcacagcttctgattacaggaagcaaaacacattttatttgatgaatatcaaattgaaagtaatgagaaagggtgctacctaattgtcgccaaaactgctgcttggcttaatttaggctcaactagattttgttgtatgccttagggtctgaaggcttaggctcttgagcccttgtttatgctaaaactaatttttttttagtttatttgaaagacattgcttagactttaatgattcaacaagtaagaaaataccctgagattcagagctttaaaaggaaattttgattcaccattttactggatgactttaatggaattatgtcttataaagctgtttagcgtttcatgtttcagaattctgcgtagaattctcaataccctagagcatcttggcatttttttgagtcttatgactttagttactaaagtcaagagaaaatcatggcagcatcctttataagattaactaaataatactgtgatattatagtattatactgtataaaatattagtgccaggaatgtagtgcaatgttggctaaaggcaaaggtaacttgctatctaaatcttcaagattagtaataataatcacaggacacaagatcaatacaatcacaactgccttttaaaatacatttttatttccctgaaatgattggtcaagaagtactgagatcagattttgctatcagatcttatttcaagttcagtatgacattttaggtgaggaagggctatgcttgatggaagttgtacctatgtttttgtggctgctgctaagcaaaaatagagtgtgcagaaagcagtttggcagtgccacaataggttaaacagacttacctgtgactgaggagtttcactccttggtatatataccccaaagaattgaaaacaggtgtttacacaaaacttgtacacagattttcatagcagcactattcacaacagccaaaggtggaagtaacccacatgtccatgtatgtatgagtggataaacaaagtatggcacattcatataatgaacaatagtatgatagtacaatgaataagaattcagccgtgaaaaacgatgaagtcctgatacatgctactacatggatgaaccttgaaaatgtgctgagagaacccaatcacaaaagaatacatattacataattccatttatataaaatatccagaagctggcaaatctgtagagatagcagattctgggtagggaggagggttaggaaggagggaggaaagaggcgtggttgctcaatgggtatgagctttctttggggtgatggaaatgtttcagaactagatagaggtggtggttatacaacattgtgaatatactaaatgtcacaaatggcaaattttatgctatgtgtattttaccacaatgaaaaatggaatgtgtgacttttgatttttaattctttgtgaatcctactaaagtttaacagggcgggggtgagtcctgaaaaacacacttgtggcaaatgcggggcagagtggtgacagccatctgaggtctgcaaggtgaggcttgtacatcctgattgagatccctcgtgcaggaacctgcctcatgtgggcacagcagccacacaggcagccgctccaggagcccctgatgccctgcagggctgttggcagtttcaaatatagcacagcttctttgaaactttcatgtaaagtcatgtaaaaccggaatactgagctgtttaaaacccaagcatacagaaacccagcagatataaattttaactgcagtgaagccaggataatttcagtttatccaatgaaaaggaaaataaacttttatgttctggtggtgctataataagtttagtgaaaggtgtatggaaagtttctagttattgctccacatgttctttttccttgtccttgggagcatgccactttctcttcttcacgccatattctactctcaaaaggaaatgctttcgaatgtttttttttttcatttagacaatgaaaataatatttgattattacaaaaattcagaaaaaatggaaatacttttttttaaaagacatctcaaccattcaggataatactattgatgttttggcatgcatccttctggtcttatttctatgaccatatgtgcacctgtatcttgatttttcactgggatcatactacatttatcaacatagcatggacatctatcctaccaataaatatcaatcaataccatacttttctttttttagagatggggtctttgtctgtcactcatgctggagtgcagtggtatgatcatagctcactgcagcctcaaactcctaaacttcaagtgatcttcctgcctcagcttcccaagtagctgggattataggtgcatgccaccatgcccagctatttttttttttttttggtagagatgggttctcactatgttgccctgactggagtacagtggcatggtcatagctcactgcagcctcaaactgctgggctgaagcaatcctacctcagcctcccagacatcataacttcttttttttaacttttagatttattcttctataatcttcttttttatttttatttatttatttatttatttgagacagagtctcactctgtcacccaggctggagtgcagtggcatgatctcagctaccgcaacctctgcctgttgggttcaagtgattcctgtgcctcagcctcctgagtacctgggattacaggtgtgtgccaccatgcccagctaatttttgtatttttagtagagatagggtttcaccatgtgccaggctgatctcaactcctgacctcaggcgatctgcccatcttggcctccctaagtgccgggattacgagcgtgagccaccacgcctggccccaaacataatgcttttaatggtgatgtagtgttccattttacacacatggcatgactgtttcttgatcagcgttgtagaggagccaggggctttccttggagtggctcttttgtggttacttagccctctgtcagagatggttggtgactcaggttttctgaaattattttctcttactttttaaataatgattagtgatagccctcaaagcagagatgatggacaataaaggcaataaaggtccataaaaaatcagcttaaaccccactgcctttaggcacatttcctgactgagccccactccatcagttctctccgccttctgtgtcccaacagaagagggatagagtagtaggcaagagcatgagctttagagccagactacacgggttcacattctggcttttgtgacattaggcaggttatttaacatttctgtgcctcagttcacatctgtacagtggggataatagtagcaccacctcctaggctagatgccagaagtccctgctagcacaggacctggcacacagtactcaacaaatggcagaggttattgctattactcagtttatttaagtggccctaccagtttgtggctttgaaagatcatctatatgcttggacagtgcaaatagataacagattctgaaaagttcaaatgccagagagccttttacagtgttttccatatagcgagcctcctgccaatattactaattgattgtctgacctgacttgctgaaattctgggatcatcttggttggattttgcattcatttcccattaaaaatacaaaagcaaaaccaaatttaaacaaaacaaaacaacccaggaaacttgagaagtagatgtagattaaatgaatttcctttagataggtcaacatcaatgctgtgggctttcctagactctatggaaattcttgactaggagaatctagaattattagatgataatgtccagaaatacctaaaagaactgaaagcatttattctgaaagacctctttctagcagaaggccaaataaaattttctattcccttgtttattcaggattcttgggaactgaattatttccagtaaataaattttctagacagtggaagcttattcctgtaaccaccataacattttgcattttaatcattttgatataattctgtctggtgtatgctgcttagtttatggctttcatacagagttacattgaaaacaattcagccaatttgctaggccttgagtcgtcttcattgatatgttgttgtttagttttttttttttagctctgcctaataatctcagtaccatttgccttctaaagatgcagacagctgtacgcttacataggtcttttaacttttcatttttttttctcttgtttttttttctcactgccagggtgtgtccagttttactttttattacagaaatgtgcatgattgctttccccatcccaaaacacctttctaatttattaacttacaaattttatgtcccaggaaaccagaaacccaagcctgttactattttgtgtaaggaagattaataggcattgaataaagtcatgtacttagtaataggttttttgaccattcaaagcctttaaaaatttacttcctggttgcaggctgttatttggtaggtgtttaactctgggcaaaatgccattttatttataagctacagtgcctatgattttccattctggcattggtgccttcctgctgctcccaaattaagaagagaaattaagttaaaaaaatcacatgacctctgtacagttggtaaaagttttgtaaaatggaatttggatcttttaaatagaaggagatgtaaaatactgtattcttagatatcagtttataaatgtttttccatttttattacagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaagtaagcttttgttttattgattctaatcatttacatttctgtgaacctgagtaatgaaggaatttctattttatcaaaaagtgcaaaaagaaaatagacatgtgtcatcatactcatactctactatttagcacaaacaccttaaatcattttcggagaagtatttaggtacagatatttcccagtgatggagagcttgtgtgtgtgtgtgtgtgtgtgtgtgtgtgtgtgtgtgtgatatggcatctggccctgtcgcccaggctagagtgcagtggcgcaacctcggctcactgcaacctccacctcccaggttcaagagagtctcctgcctcagcctcctgagtagttgggactacaggctcgcaccaccgcacccagctaattttttttttttttgtatttttagtagagacagggtttcaccatgttggccaggctagtcttgttgacggaataggggaggccctgtatctttgaaagaataggcttctcccttgcatgttcttttcatttgtttctagaagctttcaactgaagcatagtaaatcaaaatgttaggagggttaattctgagatgtcgtctttttacattattttagtactgatggggatttataaatgtaacttttataataaatagaaaatggaattttcaagcaaacattctgtagaatttctttgaaattatttcttcttgaaaataatgaagttcagtataagctatttcttatacattgattgtgtgcgtgttgagcttcattaagtcattgttacatacaactggatgcaaacaacttaatgtgttttttttgcattcatcttacagaccttatacagtggggagaaatataaatttactgatttcatctggaattagaaaaatcttagttcttgctctagcttctaatccgtattgctgcacaccactgccatctctcttccttgtgacttcttgccttatccccaaacttgaagtctgaacccaagtggccaactgcattccctgaatatctgtgtaggtcccatagtttgtcttagaaataatcattttttttattaatccataatgcatcctctttgagtttttataaagatggtatttttccttgactctttaagctttcccaagcttcctagaagatgtgtggcctgagttttgcatggccctggccctgccttccaccctggtgttgcccccttccccagagtgagaagtgtggccctccttcattcaaggaacacttcttaggaacaatggggctgcttgaccagatagcctgaggttcttccagatccatcaagctttgattctagatataaacattctcattgcaaagaaaagagccaactttctttcctgttggttctaattttgcccgatgcctggaaaagtgttggctgaatgagaacattggacaagaatgtctttgcccccataagactggagaaaatgacttttgggctgctctagagaaaactgctagcatctgaaaaaattgaagtgaatattgaggccccagctggggcttccaggtgataaggtttgggtccaaggaaaagaacagaaaaacaccctcaagtcatatcatacttgtgttggaggctctagatgcctgtcaaattaagagatgttttcaaatatcagaaccatttttgactagtggtcaagaatgcagatcaattacttagagcaacacttgtggctgtagccttaataggctgtactgtcaccaaccaagaatctgcatcttgaaggaaaagcctttgtaaggatggagtctggtggcctctgaaatagaaaaagttgatgaaatgaaatgtgactgttcttccttattgtgaattccaataccaattttcatacttccatgtgtacattctcaggaaacatcacaaatgtattttctttcctatagtatgtaattattactaaaggtatacaaggtatataaaagctcatttacgttgttttaatgcagaaaaaatgtattacccaccaaagacattaaaaggctgtgcaaatcctccagattacctttgagtgatgatcttctagaatccttattgtcaaggtaagttagagttccactcttgatagggattgtcctgcatagttttatttgggggaccattcctggttttacatctccctttaattacccttgatttacccttaactgttttgattatattattggtgacctgcctccatttaagtgttacagaaggaaaagtttgtcttgattttgaatgttagagagcctattacaaattattattttatctttttaacatgaatacacacttatagatccacagattcctgggacaaaatgaaatacacaactttgttggttaggaggacattagatgtaaaattcagggcaggtttttcaaagcagcagttcctgatagctatagacatgcagtaagagaacctagggttattagcatggggctctgtcctgatagagcaccagatgtaaaacatagagattatgatgctataaaatgagagcatggtgaactgctttctaaaacacatcagttctcctgttgaacctgacttttgatttcctggcatgtccctctcagccacctagactctggccatctcttatgcttcctatagcatcactcactctagctcctcctctgacttatatatcttgataattctgacattttcagctgtgttctaggcattgtgatcattgttttggatatattatctcatttactttttgagaacagcttggtgaggtcgaaactgttatccttcttatctcatacgtaaggatgctgaggtttagagagatgaggtattttgcccaaagtcacatagtgtagaagaagaagagctctgatttgaatcctgaacttttcaaatgcacatcctctgcttctaatcattttgagttactgtctacaaatagccagtagattaggatgtcttgacagttctacctcctccttactgcttgcttctactctctcctctccatttccactatcatcattcttgttctgacccacattgcttcttaaatactgcggtgccaccacattggtctttcatccaccagtgtctaaatgtttaaatccatctttacatatagcagctaagtaccttctaagagcaaaaatgtatgtcatcttattgcacttttactcacaaaccttctgtggtgtctctttgctctctaaggaaggaccagctctttaactttgaattaagctccttctccatagtggggcttagggttcgcagctggagcattgttctcaaatagggtctgaagtagggagtccttgtttgagacaaaaggagaaaccaaaggaacagataaagccaaattctatgtcagggaactagggtccaaggtatcaggagggaaacccagaagagggcaaatctagttggatgtgtatgtgcattgaatcaacctggaataattttctagattatcagttctatttgttttgttttgattttgtttttgtttaactctatttgcttttatttgctagcagccgtgtgagggatcctgccgtgaaggaactgagatgaagtaggcaggccttggactcagagttcttcacagatatcatcccccactcccaaaactccccttcctgttcccagtagtccagccacatgggccgtttagcatattacacatatacctcctgccttccccctcccccccccttttttttttggccttttcccttgctatttcatcagtaggcaatagctcccaatggttttcacttgctgaaagcttgctcttccttcaagacccatttcaagtggcaccatatccatgaagctctgttgcattcgtttggctgataatcagagtgattatctcctgctcagaattctcacagtgctatttatgtgtctctttatcccttaccttggaatgaagagttgtgacttgaacttcgattcattcagatgcagacactgcttctgtgtgatttaccacctataaataaccaatgggttgtcacatcctgacaattttacccccctcctccactcccatctcttaaattctttgagtccacttattagctgtgtgatcttgtgcaagggttttgacctgcctgaacctcagattccttatctctcgaatgacgtaacagtacctatttcctagtggttcagaggattaattgagataacatacataaagtacccagcacagtacctggtgcaaagaattgattgaggactaggagagaaatttaagtcagggaccatagaccacacactcagacttagaaatgaactggaagaaacctgtgtctttctatgtagaggaagccatgtttttcaacaattggatctgaatgcctttcacacattaagctgtcttctagtcaggaagctgtggatgtttattagattatcttttgatggtcttaaggatgagttgtcctggaaagtccagtaatgtgggagcctggcctctggaggacctacatgtttcttatccagtgctgaggccaccaagtcatcatcctctcattctctcagcagactgttttgtctttgcctttacgatttgacattaaatgcaaaaagattgtttcagaacttgcttcgaagtcatctcagtctctgaacacatctgtctccaagcccagcttagctttgaggaggtcatcccgctcagctgctaagcagaccatgttcagtctaactttgcctctaattgtgcagtgacccttctccacactcaggggaaacttcagactaatcagattagaaaatgtctcattcccattcccctctccctccaatatgccctgccatgatttgggtcacatgcttagtgttttgcatcatctctgcagattcctttcaaagactgccctaattcctaatgggcccatcagcctgcagcttacatttatattctgcattcttattgttccccacagactccacagggctttacagagccctgaccagagtctctttctgcacagccctccttatggcacgctaagccagagccccctctgacgtctacagtctcccgtgggaggcaggcatggagcttgttgattttgttcaatgcatgctcttgcccaggaatagttttacctgccttggaatggagctgggcagctgctgagcagccgtgtaaccctgctgtgtaaattcagatcaggagatgaaaaacaatatggctaaagggttggatgctttctttcacccagtaattgttacccatgtatttctcctaaccctatattttggtaccaggattttccttctactccattcccatttttcttataattcagcttgatcttttccttattatgttaacataactcaaactggaatcaggacttcaaaacctttttgtacctggttacctcagcccctgtcagtttgtgctgtgggagctggtataaggtcaccttacttaccaagcaaattcatttcattaatgcacagagcatcagacttaaatgttctatatagtggtagcgattatccattaataataggagtgatactttgtattgatgtagtgctaagggccttagaatattttgtaaatttttgagcatattaaaaggtacattttaattggcagtaggcattattcctcatttcataagtataaactctgagagtctctcactgaaagactgtgctccaggccaagatgagcctctaatggaagtagaactacaactgcctaagatactctaaacctttgcctctatctgagctcctgagggtagggactagatctcgttcatttttgcagcctcaaagacttgtcctgtgctaacgcactggacatggggtagaaaaacatgggctcggtgtccaccagagctgctcctgcctctgcaggtcaactctactgtttcctgaccatgcgattcttgggcatttactcaacccctctgagccttcatttggatattcatattcctctgtaataataagcaaaaaattctgattgttagaccataagaggtagagggaattctgaagccattccattctgtattcttcatgggactgggaaggaaagaggcagccttctcccctaattgtggccttctgaatctagacttggaataactagagattcaagtgcaactctttccccagcagctctgtcctgagctagacttttatagttggctttgggttccatggaatgccttagaactggcctcccaagagagctggtgcctcatccagaaatatcagttaaaatggaaaaagttaacagggctttaaaatcatctcattatagtctacccagccttgccccctgccctgctcccagaggcacggttagtgctcctgtgatttcacccaacaatacctggcagtgaggctgaagggcaagggctgagccatgtggtagttattgtggcagagtgtttggtgtactgatgaagttttcacagagaagccccttctctctgtctctctgtctctccctttttcctcctttgtgtgctctctcctctcactctctctgtctctttgtcagacccatccacccacccagatgctttctaccttttcaaatataaggggatttctagttgaaaagatttttcttttaaatcccaaaccatatggacaaacagagtatcgactctatgtacaggccttacctggcagctgtgacccacctcaccagagatctgtgctggagtcagaattggaatttagaggcatgactatttagagataaccagaattacttgttggcaacttgacgcagaggcccagagctccatctcttctcaagtgtctggccttgacgacttttaccaggtgtttcaagatgcacccctgggttcgttgggtaatggactgaaaccaaatacaactgagtcaaaaatggatcttcaccgtcttctctcccttccagaccattcccctaaatgatgaggtgacctttgcaatagaggagaagaaggctcctcttcagcaaaatacagctgccactgagccttttacctctatcaagggtggaaatagagcagttcaggattattccccgtagcaagaagatggatggcttcttggcttctgtggttttcaagccatttatcattttggggagggggagtatgaacatcagtcaaacatcacatcagactcagttctaagaactcccacctagcatgacatcaggaagcatgttcgaggggtcgtattatctagaaaggaaccagaggaattgccttccctccccctttttccacaacatgtctctgagtttgtgtagtggagaaaatggtggattcgcaagtatcagagggaaagaagaatttatggaggttttaggaaaacactttcgcactgtgagctaggacttgaaagtaagaaggctgactttttaacaagcgtagaaacacttaaaagccagaattagtgctgccctttagggcagtcaccctggaaggctgcacactgattccaacaatgtggccatagaaagttcttctttggaattgcttttcaaagccttttgaaaagaatttcctccagagtggcaaatctttgtcctttgaccatggatcagagttttaacaagagccaatgtcgtttggagaggagtgaagcaggggactcaggtggagaattgggaccactttttttttttttatggaaagcacagcatggccatgaaataaggagatttatcttctatatgattcataggcttttccagattattttgaaaggatggctaggatttggtaaatgatgcttctagccatgagacagagggaggcctctgtgatgggggacttggggagataaccttcaggggtaactctagtcactgactgattgatttgttctcactcctgtaatattcagacctttgtctctgaactgcttcccctgcctcctcctcctcctctgacctatactattgttaggactggagatcttccttatgtcctgattctctccttacaacctcatctaacaagcatggtgtatagagtgcatgttataataacaaatgatggcatgaaaaatcaccctatgtcagtggcccaggaagctacgggcagaattttggagcagggaggaaaactgagagactcattcctcctgaatatactcctgactagtagcacttctttctttccacatctgacttttacatgtttactacctggaaaatcatgtctcagagtctctcatctgctttttacactccttaaaattttcttcatatcaaactgacatatgttgatagtcaaaaattatcaaatcattctaaaaagcttatttcaacaacagcagtctctggccacattcttctccaccccccagacccattcacaagaagaagccactttcagcacttctagctgcttctgctatttaaaatagcatgtacatattgagtgcactgcacatgatatcataattgatcatttgcagatactgtctgctaacttcctgttatagtgactgaaaatttagcttaatattgatttacattgctatttattcttttggaatgctcttaggatcttctctttattcctagtattctggaagttcatgatgagagagagagagagagtgtgtatgtgtgtgtgtgtgtgtgtgtgtatgtgtagctatatatagattcattgtgcttaacaccctataggcttttctagtttggagtcactgtcctttggttctgagaaactttctattaattatttaataatttcttctctattatgagaactcctattgctaagattttaaggccaggtgtggtggctcacacctgtaatcccagcactttgggaggccgaggcaggagacttgagctcaggagttctcggccagcctggcaacatagtgagaccctgtctctacaaaaaataaaaataaaaaattagccaggcatggtggtacgcacctgtagtcgcagttacccagtaggctgaagctggaggatcacttgagcctgggagatcgaggctacagtaagctataattgcaccactgcactccagcctgggcaacagagcaagaccctgtatgaaaaataaataaataaataataaatagaaagattttagagctctcgaatttggatattttctctcccagattttgttttttattaggatgcatttactaagggatttccttaagtttatattccagcccttctactgcatcttttactatcatattaaaaattttaattccaagagcacgtttttcatccagatattcctttcttgtagtcttctgttcttttttcaggaatgtaatacatcctcatatctcacatctttccctgtgttccctgaattgcctttggttccttttgttttttgtttttttttgtgttgctgttttggcttctgtctttaatgttggatgctttggtcaggggaaggggtttgttgattagtggatttcactacccagtcaactcctgagccttcattttattagagaatccccagaagctggaatctggagatttctctggaaccattcagagtgtggagagaagaatcctatcttctcctgcaaagataggagggaggttgtgatggggaaagggagagtttacgcatggccactggtattctaggaatagaaaaggggaaggaaggcacctgaccgcccctcacctctgcactccattttgcctcctctccccaaactggagcttctttcattgaatttctctggagaacaagcctctggtctctacagggaggagcacagtacggaggaagatacttggctgttcagttgctcttgctttcttttttttttttttcttttgagacggagtctcgctctgtcgcccaggccggagtgtagtggcgcaatctcggctcactgcaagctccgcctcccgggttcacgccattctcctgcctcagcctcctgagtagctgggactacaggtgcccaccaacacgcccagctaattttttgtatttttagtagagacggggtttcactgtgttagccaggatggtctcgatctcctgacctcgtgatccgcccacctcggcctcccaaaatgctgggattacaggcgtgagccaccacgcccggacaccgctttctaaaggctttcaaacaatccgtgttttcagtgccacaccatattcctgcctttattggcacctggagtctgcagtcacttagtctcccaggaattttgtgggccaaatcgactggactctgagtgccctctccccactgacagggacatttagggttcagcttctcttcctcagctctgccaagttagttaccaatcctctgtttacttttcatcttgaaaagagtttgacgtctcttctctaccgtggtcttttttccaattctctttgtcattgtgggttataacctatttttattgttttttggtcattttggtaggattttggggaaaagggagagaaatacttgtgattgattcatcgtgatttactgcaaccctatctacttcccaagagcaaagaattcttccaagaaacatgagctagttttattccttttaattgaaatatcctttgttcttttctcccttgtgcctcttggggggattcccacacacactgagatcctctaagacagaactgaaaaggaaaacttggagtattttaccacattaccacaactcttcctttaggcctggctctgggattttggaaagatgaactcgttcaagcattttttctcaaaaaacttttagacattatttctgagctatgtatacttttattcagtggaccttcctgaatatcatttgattcctaaatattcttcttaaatgtccccctaaatggataaatggttcaatgttttgagtctgacatatgaactgggcaggaaggaagactgggtgttatgaggtaacaagtaaatatcagagttagtggtaacaacatttaatgataggacttcgtgtggtgacttccagaaattttccagtaagttccagagccatcatctagggcaaatgcaaattcaggcatagggactcagataagaggaacttcaggaggactttctaaggaagcaacatttgaaatgggactttccagacaaagggaccagaagtgcaaatgccttgcatttctgccagcaatcttggcatgatcaaggaaccagaagaaggttagtatacctgaaacattgtaaacagagagagttttcaagtgaggagatgtaatcagagaggccatcagcagccagattaagttgggtcttataaaccctgataaggagtttagcttgtgttctaagtggattgggaagccactggaggattgcaggcaagaaagtgattgatctgatctgtgttttagaaagagcactgtggtggaggatggtctgctgctaggtaagagtagaagtagcaagaccaagacaggaagttattgctataatccagatgagagacaatagtggcttggaattagggagtggtaaaagagatggagagaaatagatagacttgttatatgctacagtggtagaacccacaggactgcttagtggattgtatatgaggagtgaagtctgatgtgatcctagatttatttggtagtctttgactggttcccagattaccaggatactatacttctgaaacccctaggattgagtaagtgcctcttataattgatgtaatgggaatttactgacaaattctgtactttaagaacagatagagaaacttattttattgatgatctcctcaagtctcccaattttttggctttaaataccttccatatggctaatgactcccacatttatatcttcaaatggactacttccttgagcttcagactcatagccccacttgctcactttccatccaaatgtggcatatctaaaactgagctcatgatctttccaaccagcagcccctacagtctttctcatctcagttagggcagctccattgctccagttattcaagcaaaggcattggagtcatcctgaatactctctttttccctctctctcttacataatatatatagtcttttaggaatcctacattcaaaatatattcagaattggccactcctcactgccttccagtgccaccaccctcatctaaactgccgttatctctcatctggatccctgcaagggacttctaactgtccttgccacttctgccttgccctctgtgttctactctgaatgtatcagtcagagtgatcttttaaaaatatcataagtcccttcttagtctgttcagattgctataacaataccgtaaactaggtggcttataaacaacagaaattcattgctcagagttctcatggctgggatgtccaagaccaagatgacaacagatttgggtctgctgagggcccacttcctggctcacagatgatgccttctctctgaatccttacaggattacatggcagaaggggcaagagtgctctctggggtctctttaattaatataagggcactaatgtcatcatgagggcagagccctcactatctaatcacctttcctaaagccccaactcctaatatcatcacattgatgaggcctcaatatatgaattttgaggggacacaaacattcagaacattgaaggtctcataacctttctgtataatatgccctagtgactcttagttttcctcagcataaaagccaaaggtcctacatgatctcattctttgaccttagctcctactcaggatattaggaaatactttctttcaaggctctgtgctaaaaaaaagtttattatgagacatctttaattgagttttcattcttcccccaaaacatacacaaataaaagaaataatggtcctacattttggctataaatatttccataaacagagtatgtcctttaaaggagttgaaatgactagtgagccataatttaaagggtggtaaacagtgggtagggggcagcatattggaattgtatcttagaatccttggccaaagaaaatgtacacaaaagaattacagaattcccctttcccctcttctggtcactttgtttattccattttgtctagattgatgaggctatgtgacttcagcttgtaacatttaatttattgctgctaatttttattagtttataaatataagctattaattttttagtactttgagaagaaaagagaaaaatctttggactgattaggagtatattttaagggcaggatcctggaatagggtgcctggaacaatgtctagtgaccactttgtattttccttcaaaaactggtgttacatgataattagccttaaaaactggcagaatgtgatcaaatttaggataggtggcattgaggcattacactaagtaattttgtgtttaggtcattgtagcaattgtgttgaaattactgtatcttcatggccaaatctctattatggttaaggaagaattttatctaatatccataattaggaaatagtggtcaaagagattcattattttgacctatatttttctggtacagaataatcatttgttaatttttgttcaaaatgaaaatgagctgaagtttttctgattataaacttaaaacaattcagatgatacacaaaagtctaaagaaaaatcaaaaatcagaatctctcttcccagagatatctattcttaatatgtaagtctattgctaccatattttttctgttttttaatatataaacctaaagtgggattgtaactctacatactgttttacagcctcctttctacttaaccgtgtatcaagaacatatttatacgatagcaaatttggatctaaataaccccttttaatggctacataataaatgataaagatgccttttattttttcaaaacatatactggtagaaaaatgaatctagcttgccttaaagatttaaaaggtatgcaattgaagaaatataaggacattctattttgctgacatgtaatatcaaccattaaactaaaaggacctttaaatctttttaacaaaatttcactatagtcttcattactgaatgagcaaatttgcgtctgtggcaactacaacaagtatttattgaacacctactaagtgccagcactgatcttgttggggatattttgatgaattagataggcaagatccccgctcaaagaatttacattctggagggtcagaagcaataagaaattgtaagaaataagaaaactatcagatattgaagcatatatggtattatgttttcatgataaaattgaaactgacattttggtcttgaattctgcagattgagtcaaattatatattataattatattttcaggtttgaagacagtgaaaaacaaatagattataagtcatttttctctgccctgaactggagaaagaatccagtgcctgaattgcaaccagcatcataccttaaagaggtaaaatgaatacctattttaaaaaccatctatggttacttcccttgcatgtttaatatcctttatctttaaattatttttcattataaaatattaacatcagtgcttttggaaagagtgcttatgtgtttctgggcatttgtgttaaaggttaatttactttccatgctgagcaaacatctgctctgtaaaagcatgacttttcttatgcagctgaattttttttaacctcgatcgcatccaattatatggaaaataggataataggttacagttataaatagatataaacactgttatcaagggattctggtaacatcatcataagccacaagagcaaatctcaaatggtgcctatggcaagaatccctagggtatccgggtatccgcggctgtgcacacaggtttgccatgggtgaaacaatagagaatggggatgcacatttcacagtgaaaccaaatttaaaatcaaaattctgtagaaaaatgcttggttagggaaaacaaagttcacatgatcagatggtgctctcaacattgtggaattgtctgaattctctaagatctctttggactaattgtctttaagaagtgggtgggtgggtggtggtttgtttgtattttaacatgctccagaaattgattttcttgggaaagtcccttgataaagcaaatgtcatgtggttgatactcccagaaaggaggcatttatttctcctggtctctgctgaccagctcattctggctggagctggtctagtgcctctgggagttccctcaggcatgcagctactccaagggcagccatagaacttccagatggttgggggaaagtagtagcctttggagtcagacagagctgggtttgaattttggccctgccacctacttagctgaatgactttgggtcagttaagttacttatcttgttgatttatgaatgtaatccccagataaatcaggattaagtattgactctcatcaggttctctgctgtaggctggggtccagagacaaacattgtcactgctacctttgaggggcccactactgatgggggaattggtacgttcgtgatttggagtgtggcatgatacagcctgcatgggattctatgggatgaggtggtagctgcttctaaacagactgggggggaacaggaagtattttcaggggaggtgacatttgaaatttcaatgatgagtagtaagagttagcaaggtaggaaagtgacatggtctggaaaaggcatttccaacagaattctctggacatgggacagcatggcacttgtacagaaccaggaggaattggtgtggccagagcgaaggcacatggggaagaggtgaaaaggatgaagctggagatacctgtaagggtgacatttgaatattgtcctgcgaggtctggagaccactgactaacttcaaggaagacagcaacatgatcaagagtgccctttacagggaacttgctttggctggatggtgggtagactggagatggagtctcactctgtcgcccaggctggagtgcagtgatatgatctcagctcaccacaacctccacctcccaggttcaagcgattctcctgcctcagcctcccgaatagctgggattacaggtgtgtgccaccacatccagctaatttttgtattgttagtagagacaaggtttcaccatgttggccaggctggtctcgaactcccggcctcaagtgatctgcctgccttgacctcccaaagtgctgggattacagacacgagccaccacgcctggccatggaggctcttgtcctgttgtccccatacataacagcaaacaaagcatttactgtgtgccaactactgttctaagatctcaaaatcacctagcttatttaatcctcttagcaatcataggtgcatttattattcccagtttagagatgaggaagttagggaaacagcaatgtaaggcagagtcagaattttaactcaggtctcttgctgcaaagaatacaaaagaaaactgtcctttaaatataattatttttgaagacaatggattggattaacccaaatctgaaacactatcacaaaaacaaatcaatactgtcatttgccctgataaccctttcattctcatccatgtgaatatttaatttttacatacaaatagaaacatggtagatgggatttacattcttctacctttttgttgaatgttctagtagtctatattgactgtgtccctgtgtccctttagcactgctctccagagccctctaccgtgctctgaccctgcccaggccagtccttggcagctgacctttgtaggcacatcagtgggtcccctaggcctccagttgggttgaccagtgggatgcaccagcaggagagtagagggtgaaaggagagagaaatcttcttcctccctgccagtcacagcagattgacggcctcctccttccaaagtccacagcacttgtctagaggctctttgcatatggctggtcactccaggcgctggtaaccaccctcatgtgccccttcagcctcaggtggtagtaatggctccctgctgttataaacccaggggactagcccctattggtttttctaaacacttcccacaactttgtaactagtcactttattaaactcttctcgatttccacagtttgtatatgtctgccatttcccatgagcccctgaataatatacaggacatacctatttttgctataagcctttgtcattgttttccttactttctacttctctctttcctcttccattccactcaatccaccacccaaatgtttacctctgtgttgggggttttatcatttcctcatgtattgtatgaaaataagatcataccacatgcatttatctggagtgtgctcttctttcttaatcgtggaaaatttccctagtttaatatgtatagacctaagccattcttaatagctgtggtatgaatatataataatttattaatctcttttttttttttgagacgaagtctcactctgttgcccaagctggtgtgcagtggtgtgatctcggctcactgcaaactccatctcccaggttcaagtgattctcctgcctcagcttcctgagtagctgggactataggcacacgccaccatgcctgactaatttttttgtatttttaatagagacaggttttcaccatgttggccacgctggtcttgaactcctgactttgtgatccgcctgcctcggcctcccaaagtgctgggagtacgggcatgagccaccgtgcctggccctattaatctgctctttattgacaggcattcaggttgtttttacatattttgcctctgaaaacatattttactactttaatttttattttcctgatgactattgagtttgaatgagatcctgtcatctttttgtactacaacctacagtaagaaagattttttttcataacaacacagtatgcagatatataatggaacaaaaatttcacggattaatattgttctgactacatgtggtgcagtatgatacattttcttttttcatttctctcttcctttcttttcttttcctttttctcattccccaccacctctttttctcctctcttttgaatgttgttcgtgacccattaaattgatttcatgacccacaaaaagatcaccatccacactagaagagaagtcactgcatgggaaggccaaagatccactctgcctttaatcacccctccccagtttcatcacttcaactctgtcaactgggacaggtatcgagctgtggacctcagatgcttttgagaggcaatgtggaacagaaggtctccaatcacagggaccctagttcaaatccttagctctacgatcaactaactgggtgactttttacaaagcactcaacctttcaggttttcccatctcaaaaatggtgataagaatagttcttccattagggttgtgaggattaaggaagtcaatatacacaagtcacttaccacaatacctctcccatagtaagggcttaagtgttagatgctattattttctgtaaaattgagatgtcttactttcctcaagtcagggggctgggcagtccctgccaaggttaagatgggagattctattctttaatggcaagagaatggttctaggccaggaatgtcacatcagaaacagctgtgcttcagcactaggttcttctaattgcgattcatttacggtgagaaatttactcatagggcctcatcatttctgctgataaagcctagaaatatttcagtctgcaggaggcattcagaaaggactattctttttcagccaattaaaaagaaaagaaaatagatataaaatggtacctgatcaatttcaccaataatgagaatttaactagattccaaagagttcgaagcactctggtactgataagcttgttattatttcataaagaagacataaaataccttgggaatgttaccagtgagtctgtaatctcatgtgaaaatatttagcatgaaggggttgagcacaatgttgaatagtttatacagtagaatacaggagcaaaaagtataatatctactgacccatgtaagtgtgctcaaatgttattaataatgttgaataatgccctgaaacactgctgggtcagagtttgtcacaggtggggttctccaggaagcagatggagtctaatgtgcaggatgtttttttgggagtgtccttgggatcaactcccatggaaggtgggggaaaaaaagaagaatgggcagagggagaagtcgaactgtgatggaagcccaaagatatccttggccaacccatagggagctctggagttagcatgtcttttcagcgttgtcctgagttgggccagaatggcctggcctttgtcctggtgggttggttcaagaagagatatgactttgtgcagcgtggctctttgtagccaagacatgtttgtagctcaggaaatccaggaaggggactcccagcagctgggccaccaaatccctcctcaaggggattctgggtagtatatcacagcttggcaaccaactactcttgaagcccctgttgactgttcttggtatcaactgagagcctagcagtgtgacagcctcctccccagcttgttccttggttatttcctgatcttctattcatggtagggaactgagaggagagtggttatgccataagaggccatggtggagtcagaccagatgtgtaggtcccgggggtgcaactgggcagagaaaacctcccagttatgactttggggattgccaacgtttggggagtcttccatagccagccagtcacatgtagggcttcagggtaagatccatcaggttgtgaaggcaccccagccctgagtgtgaagtgatgagaccagaggtcttttgagaagaaggaatggcaggctgagctcccgtgtggaagcaaagcttagatggaggccccagggttgggaagctgcacccttcctccagtatatgagccggacaggctggcttgggttaaagtttcagaggtgttatgaagagctctgtagaagttaccaggacaggccaccacctggaacgtggatatttttactcctgggctgcatattgtcatcagcaggatctcatttctgcactgggaatcttccttagaaataaaaaaaacttattggctgatgaaagctgagtaggcttcagtactagattcaactctaattctgtctgcatcagcgtgaatggataggatggatgttatgggtggaaatttgggacaccttcccagtctagtgtgactaaccatcatggggtgagaagggagaggtcagaaaccaggaacaagaccacaggcttcagccaaccacaggctgagtaggggtgtggtctggtccacaagacttgagattggaagggagttctagcagggcatccctccaaaacagtgagcatagtgatggggaatcttgaagttagcaccattcggcaatcagagggagccactcagcaggctcagaccaagctttcaccctgccaaggggacagagctggctaagcccctatacccgtgaggttatagctggaaatacacagcatactcaaagggatcctggagatggatttgataaagggactgttgacggggtgggtagggttaagggaaccaagcggggcggggaggggggtggagcactcagggactggcaataacgggagaagcagggagggactgggggactggtgttattggagcccagcagaggagctggaactatagcagcaggtagagtagtgtagccactatagccactcccaaaccatggcctggcagggagggaacaggatgaagggaagtgaaatccatactctgacctcttgcttctcctgttttctgatctcctgatgctgcttcacattggctgaacccacccagaagccagagagcaaggaagcttgaggagtgatgcaatccacagagtcagtctcccagggcagaaagcagagtgaaaagggcaaagaatggatcttgaggggcaaatggagactgacccagcacaatctatttgttaccagaataaagccttgagctcagaacaagccccacagccaggataaaagctaggtctacactaactgcttctggggcttggtctgctggatttgaggaccagtttcctggactcagaggtggctcccctacatgtgctagttaggtggcctcagctagtaagaataggggtcaacaacaaacaaggagaatttaaagagtactatagtatagctagtctagctttgattagtcctactgtcctttggtgacaggtttttcctacatggttggatgtaagccatcatccatcatgactgtcggctatggcctgtagccaatggcctgtagcctggattctcattggactcccttggttatccctctgcctggcccatcagcagcccatggtgagccatggggctgtaatttaactctcactccattatgtgactatctatggtctcagcatgttgccctggcactgtcatggcctggagaccccatttccattctattgtgtttgctcacagatggtagctgtaaaactggcagaataggtcccactgtttagagcctgtctggttaatctcagaagtcacgttttaaaaaataacactaaatcggttctcatataaactttataacttacactgtgtgactggcgtcttatcttttgacatttctgagaaaaattggatgtggcttcattttatgaacatcgtaactgcagaagcattagcagtcagctctaaagcactctctttcacaataggatgatatacggccttggcatcaggaagtagggggcagttgggtacaccttgggaaacatctttggacacccgccttgttgagactctccttttggtatttagagcatggaataacctgtgacattttgttgtcccaacaatcttgcaagaataagtattatccccaatttatagacaggaagctgaggctcggagatattcctaatggtaaggattgtatagtcaggggctggtgccaattttttaaataagtaaagttatttctaatatttgtggttgaatataacagtcgaaataaaaggttgttaaccattcctcttagacttaaaaaataactggcaaacacatactggtgacctaacacagagcaataacctagtaggaaatgatactcctggaatccactttcatctatagcatcgggttatgtccacttgaattgtacacataagcctatcactgaagctcaaaaatccacatctccctgaaaactttacttgccctgcattgcacttccaaggaaaggttttgtttagaaactacgcctgtcttttagctacaactcacacatagatgacaactctgttgaagctttgtctagggaaaggggagacaatcatgaaatattggcattgctgtaaagtcagaaatgtatagaaatataagctaatcttctggttttatatatgagcttttccttatgttatcagaacgctcttgattatctcaagaaatattcgcaaaatcctcttccccaaatttatttcaatttgatttgcttaaaatttaattgcttttatgattttgtcaaactaattagattatttccaaagccatgttaactttatttgaagggagaaaatctgagaaaaacacaattttaatactatacacaccactggccttttccataaatgtatagatatttctcatagaaacatccttttcctagtgaatagaggggagtaacatggtgaaatcaccaacatgactctatctgccttgcatttgggaggaataaaaataaccttatttcagtgaagcatggaatttaattggctcccgatcttttcccctcatgcatctggtggccagtattacagcagaaaattttaaactagaaggagacataatccaattaaatttccttttaaaaatgtcaaagcaaataaatctagggcccattagctcacacacagctttgctgttctcactgggcagctgctgtttactgggttttcatccagtgccatctttgcttcccatttcaagggtgtgcgattttacagatcggcagctacattttttcaccactgatgaacgagtaatttattgccaactggtttgacatcttaagtgcctcgagtgacagccagcttggaagatgtcatagggccttcttggagacaatgattcccagacattttagaatcatgatttttgtatcattgaatttcactctgcatttcatagttcttccttcttccagaaaacactatgtggcatgtattgtttatgctccagattacatcaagttttcttctgagatttgggtgctgtcttttgagttatctggaagtgacttggagactctggatccatccagtttgccaggaagttgctttgtttcaagctgtgctgtggctttcttaaacatattcttaattttgataaatgcaaaattgcatagaatctacatctgacttcctctagaagcagacttggagacaaagatttaagtgtaaatcatttttgggggaggagtgaaaacactagtaaggaagtgggagagtgagaaaggaaagggaaggagctactaaaggcatattagcaaaccagttacaaatgtagatgatgtagacgattaagagttttgttttgttttgttttgttttgggacagggtctcactctgtcacccagggtggagtgtagtggtgcgatcatggctcactgcagccttgaaaccctgggctcaagcaatcctcctacctcagcctcccaagcagctgggactacaggcccacaccaccacaccccgctacttttttttttttcttttgtagagacagggtctcactatgttgaccaggctggttcagaagtcctggctttaagtgatttcctacctcagccaccccaaatggtggaattgcaggtgtgagtccccacacctgacctaatgattagagcttaatgcaactgggaaacactgacacttcagagtcatcccacccaaagtgcaagggagctgcggtattcatccatcaactcccatcagtcactgtttgagggctgctcttgaagtggaggaaaggaaacaattccctggcacttgtggcttgccacagggacagccaaagcaagcctcagaggccaaagagaagcccaagggcaaaggaacccaggtgctggcagttggaagtcagattggtgtgctccagagtggaaagaatgaggggataggaaggggtgctggcagagcctgctgcacgtagacagttaagatcccaaattccaaacctgcactgccaggagaatctgttttacagagacacaagtaagcttgttctcacctggaatgggtgggatcaacttctgtggatgactcctcctgttgtaaaagtaccacgcagttattcccacttaaaattgatatgcattgctgggaaagccatatgatatgagtttgctttgcattgcatagtgtaggattaataaaaagtcaatgaagacagtattttaactcactgcccagattttcataaagattctataatatttggaacatttgcagatttattaggaagtacaattaggcagtggtaatatgtggatttcttatgttgccaaaaatgtcttcattttaccaaggggctggccatgagattccttaagtaaatccgattatagacaaaattatgaagaaagtgcctttccctctacttaattgatgcccctcaccccatcccctgagccttggaaacctcccctgtttcctaaccttcctttggtcccaaatttgattccattagtcaattgtaagccaataggtgtgataatctccctgaaattgggggttggcaatagatggacccacagcactgttaatgtgcttgtggcatttatgaagtatttggacagaaagtcattcccatctggaacctaaggaagagtgacaaaaggaaaaataatcaagggaagtggtattgattcgaaagaaagagcacaatggggccggcatagttaggagagctttgtgagagccatggggtttaaagtggtcaggatttaaagaaatggactgctgttatcttttcatcttaaattatccttaattccaaatctcatgaatatttacttgagtttccttgtgcccaagttgctaacaaatttgatctcatctccagattcttgagttgtcaagattgcattttaagttctattattttctctgtattgtcagcatttaaatcacaattccttgctcaaaaaatacaaaaacaaaaccacttttgctgactcataagccatgaggcagaatcttctagtcctgacctgtttcataagaggatccagtccccgaataatttcatcatatttatatgagttacataatgcattatttctgtgttgaaaacttttatttggaagacctattagaggatggtgatttttgaaggcatatatttgtactgtttctctataatgagattaaatttacaaacatcacttaagagcaaatattgctgtaagttttgtaatgaaatttttgaggacatgttaaatagtggagttgaatgactattgatcttagccttcattgattaaaatatattgttttgtgtgtgtgtgtgtgtgtgtgtgtgtgtgtaatggtttactactttttggtgtaagtagtaagtagtaaagtagcaactttgttttaccaagttccatgtggtatgagttgcacaaaacaccccttaggagtgggtttagccatcagccgtctgaatggtgatttccctcttcatactgccagttggtggtttgggctcaacttctgagaggcagcatccttgagagagaagagtagtgtcgcttcaagaactgccttgttttctacttaacttttcttgttggaagtgtgaggaccaaatgtagctatgtaggacgaaagccagctgcttctgaatagatccttgtcagctctggagggtagccccgcagacgagcatagttccgcagctccactgcccaggttattataatccaggcttctccactgactggaggtttgacttgagacaatctatttaatccttctgtgtctcagtttctttttctgtaaatagattatcatcataatacttatctcgtaaggggtttctgtgatgattaaataacttaatacatgtaaaacacttaaaagagtatcagccatgtagtaaatatccaataaatttattgttattcctattactactaggtaattacaagattcctatctataaccctgcacaaatctgcaactagtttatcatcatcataaatcatctctgaaattaaggttttacacctgaattagagatgctggtacttagttctcttctgattctatgacaatgttatatttcatatatgactcatatttcagtgacttctatatctttgcacagttctggattctagctctgtgctatatagaaccgtatttacagatgtttaccagaatcttcaccttgatgtcccatggacacctgaaagaaaaaatgcccacagttgaacttagaatttccctctgagccttgttttcctactaaaaaatgtttttcaacttttcctgctttccttatgatataacaccggattgaatattgtcccctccaaaactcatgtctaccctaaacctcagaatgtgaccttatttggaaataatctttgcagatataattaattaaaatgaagttatgctggattagagtggaccctaaatgcattgattggtgactttataagaaagctgcgtgaagacatattggtatacacagagaacaccatgtgaagttggaggcagacgttggagtgatgtgcttacaagccaaggaatgactgccagccaccaccagaagccaggagagaggcatggaataaattcttccttagagcctccagaaagatccaacgctgccaacaccttggttttggacttctggccttctgaactgtgaaagaataagtttctgttgctttaagccacttactttgtggtactttgttacggcagccccaggaaactaataacagacactgtcaactattactgaatttagaattcttagaaccatccttacctgtattagtttcctagtgatgccctcacaaagtaccacagactgagttgcttaaaacaatagaaatttattcttccacagttctggaggctagcagttcaaaatctaggtgtcagcagggccatactttctctgaaacctgtgtgggaatccttccctgcctcttcctagactttgatggttttctggcaatctttggcgttccttggtttgcagctgcaaacctctaatctctgcctctatggtcacctggtgttccccctgtgtgtctctgtctttacctggctgtctttttatagggaggccagtcatattggattaggggcccaccctactccggtatgatctcattttgctcatcttaatttacctaattacatctgcaaaaaccctatttccaaacaaggtcacattctgaggtactagggattaggacttcacataactcttttgcatgaggacacaactcaacccatagcactacacctttcttttgtcaccatttcaagttgatccccttctagctatttcatgttctcctgcagcagcatctctcagagtagctcctgtcctccatgcccgcttcagccaccctggttatggcacagtcatttttctgcggtattatagtactcacctccagattgattttcttacttcatgtcattctctgtacatccagcaagttagctaatcagtttctaatcagatttctgtcatttccctggccaagacctaccagtgacttcccctaaccacagcctcaagtataaactagcacagaaggccagaagtttggccccagcttctccttctaaccatctctcttgccactttgcaccatgtgccgcaaaccacactgggctactcaccctttcttgaaaatagattttagatctccaggcctttgcttacgctggtccctatgcctggaatacccttcacaaccctaaaccctctgctgaactgtttttcatcccataaggtgcaactgaatcaccacttattcagcttgcttccaaaattccatcacatcaaattattgagcctttacctatgtttctgtgacaccttgtgattctggatactaatgtaacactagtaaagatatagaacctcttatatacaacaattaaccttgacagtcatattttaaccttgaaagtagaaatataagcaaccatatgtatgaactttgcctcctgttgatattaattaaccattgaggcatatgcaaaaagtttgtgtgtgtgtatatacacgtatttatgtattatataaaatgtgcatctgtgtgtgtatatgtgtacacacacacacacaaataaagtggcttatctgcaagatcatactgtgagtgatccagtgttcttttcattgtttactgaagaaacagtaaccaatcagccagtatagataccagtttgtattttaaaaattgggttctttaggcagcagttcacgtctgtaattccagcactttgggaggctgaggtggacatataacttgaagccgggagtttgagaccagaccagtccggcctatatggcgaaacccgtctcctagaaatacaaaaattagccgggcatggtggcatgtgcctgtaatcccagctactcgggaggctgaggcatgagaatcacttgaacccgggagttggaggttgcagtgagcagagattgtgccagtgtactccagcctgggcaacaaagtgataccctgtctttaaaaaaaataataaaataaaaataaaaattgggttcttaagaaagtataggaggatctatcagcgtattcatgctgcataacaactccttaaatttcaatggttcacaacaagacacatttctttttcttgtctatgggcatgtaggtcagtgaagcatggctggattcagctaagcttggctcttagtccgcaagtccagcctggtctgatccaccttggtcattctaagaacagcagcatcctgggccatgttcttttcatggtgatggcagaggcacagaaggccaagccaaatgatgccagcacgctagagcctctgtccatgatatgtctgctaatagtacataggtcaaagccagtcatgtggccaaccccatatcaaaggaacaggaaaatatacccttcttactccacaggaggttctacagagtcatatgacaaagagtgtgggcacataattcttatacagggagggaatgaagaatcaagaacaagtatccagtagaccacaaagtccttatgaacctaaagtagatggtagaaattttcactttgcaaataaactggtgttgaattttcaaaactgtactttgaaatgtggttctaatcatatccatttttggtttttttctagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaa

SEQ ID NO: 3362 - DNA, 195794 bp, human
aacgtgggggccaaacaacacggccgggaggcgccgctgcctgccgggccctctcttctgggaccctggattttcggacactgagcgccatggccctgcctctgctgccgggcaacagcttcaaccgcaacgtgagtaggaagggcgtccgaggtcacagctcccggctggagtctggggtccaggcagggtcgtggcgtggccacctccgcagactctcctggaggccccatgctgctgccctgggttggtggcaacttggaccaaactttataggctgcttctcccatctctccagctgcatctgaatgtttttcctaatttagaaatatatagagagagtccttataggtggcaggaccctcaaaggtaacaaataatagtgacgataaccattgggggtttaatgtgtgccaggcgctgtgctttaatcaccttatgcagcatccagtgtcccaacagccctttgaattaggtagtttttattcccagttactattgaggaaactgaggcacagaaccacacagtctcagtggtgaagctgggtttctttcaagcaaccttgtctccacagctcaggagcctaatcattatccccagtatcctgtgtgaaaaaagataccgtttcaattatcaaattgaagaaatctggcacttatcaagaggggtaggtggcagataagagttctatcagcctgtaaagtttactcccaaactttatagagacaggcacccaaacttggagggattttttttttctctatttataattgggaggggttcatttctttttttttttttgagacggagtctcgctctgtcgcccaggctggagtgcagtgacccgatctcggctcactgcaacctccacctcccaggttcaagcgattctcctgcctcagcctcccgagtagctgggattacaggcgcccgccaccacaccggctaatttttgtatttttagtaaagatggggtttcaccatgttggccaggctggcctcggactcctgacctcaagtgatctgcccgcctcggtctcccaaagtgctgggattacaggctgagccactgcgcctgtcctggaggggttcatttcaaaagaagatgaacgtacagaacaaagcaacacaacacaaaaaaccctgagcatgaaagaacttttgccaataaatagcacctcatttaaacgacagcaggaaaatgattcaggcttttgtttatactggttactacccttcacttgggtcagccatctgtgtctgcaggagaagctaattcccaattagatgggagggaattagatggagccactcaaggcaattgtgtaaacctttgataactttagaaagcaggcagcagattgaagtatttggctttatggtttccaaacactgtctgtatctaagttgttggccctgaagtacaagttttttctttgtagcttcacgccattgaattctgacccctacacgtctggtcagtccaactttgaacactgatttgtgcatttcttggttgatgggcagaggctggccttccagcatagcattgccctttggtaagtttaagccagtcacgcaaacaagaaaggcccctgagagacgggacatgaaaacagattccagaagtaaagaagcatgctgtgtaaaagtaattttaataaaaaatgaaagtaaagcctacagctttttgcccagcaacactctgattaccagtgcctgcctcctgcagaagtatcatagctctcacgtgcagtgattaaggatgggaaggaaaaacagtggatggatgaaatattaataaatctgcaaggttctgcgtatatttttgctttttaaaaaactttaagatcatgaagtacaacacatatacagaaagatgcacaatggatgatcacaaaatgaatatcaagaaattaaatatgggggctgggcgcagtggctcacgcctgtaatcccagcactttgggaagcagagatgggaggatcccttgagcccaggagttcgagaccagcctgggcaatatagtaagacctcatctctacaaaagattgaaaaaattagccaagcgtggtggcacatgcctgtagtcccagctactcaggaggctgaggtgggagaatcatttgagcctgggaggtcgaggctgcagtgagccatgattgcattactgcactccagcctgggcaacagagccagaccctgtctcaaaaaaataaataaaataaaatatgacctgttctccaaaaataccacccttgactggggttgccagatttagcgaataaaaatacatatctcaaatactgcatggaacctgtttatgggaaaggattatttattgtttaccaaatttaactgagaatcttgtattttatgtgacaactctacctatgaacctttctgttcattaccccatctctactctccagatataaccactgttctggctcctatcactataattaggttttgcttgcctttgaaccttttatcaatggaaatgtttggtgtttattcttttgtgactggcttttttagctcaacagtatgttcgttagatttgtccatgtggctgtctatagaggtagtttgtacatttttattactctgtagtattgcattgtatgtttttcacatcatttatatatacattttactcttgataaatatttggcttgtttggggttgttaagaatagttttactgtgactatttttgttcatgttttttggtaggattgctagatcatacagtattcgtatgttcagctgtagtagatgctgtcaaagtgattatactacttaaattcccaacagcattttatgttcctgttgctccacattctttctaacacttggtattgttagtcttttaaattttagatattttggttggtgggtatagcaactctttgtagttataatctgtacttcctgattcctaatgaaattgagcatgttttacacgtttgttggtcatttgtatgaccatttattggtcactgcttttttttttagacggagtcttgctctgttgcccaggctggagtgcagtggtgcaatctcggctcactgcaacctccgccttctggcttcaagcgattctcctgcctcagcctcccgagtagctggaattacaggcatgcgccatcatgcctggctaatttttttttttttaatttttagtagagacggggtttcaccatgttggccaggctggtcttgaactcctgacttcaggcgatccgcccgcctcagcctcccaaagtgctgggattacaggcgtgagccaccgtgcctggctttatttgtatgaccatttattggtcactacttttttgtgtagtacttacttatctcttgtctaatgtttactgggttgtctgcctatttcttagtgatttgtagaagttctatataaattttgggtatcttcttgtctgtgattggccttttccttctcttaatgatgtttttgatgaataatttttggaaaagatcactctttctccatgtctctgcagagccactttgtcaaaaatcaagcatccagctacgtgtgggtctatttctagactcatgaatatttaaaacatttatttactttatgcctgagaacaatgggagtgtgtgcgtgcatgtgtgtatgtgcgtgtgtactagagaatgacagtaccttggactcattcaacaaatcagtatttatttattgagtatcctagtatatgccaaaattaggtgactacatttaaaaaattgttacactagccttggtactaaatgtactgtgtgttgcccacaaattaatattttaaaaacttgtacttagttaaaagattggatgttctctggcatagaatggttagaaagtcagtaaagccatatctggccttttagtcttgcccttcccccctcccctgcttgctgaattaaattaccaagtgaaaaaccttggcctcctgtagatagcataattacttggctgtttggatttaaaattataacacagctaacttttattgcttttccatagaattgaaaaggaacttatgtgccccttacttagctgccagtggtcagtcaaaagcaatagattgatttctgtccacggctaggtgatacgcaacctgtatttctctctctcaaatacaagaagtatggtgccttctaaaatatgaacatttgtacctctgatgacattacaattattttgatatgagttgaaaaccttagggaaatatcacaactaaattctagatacactgtatcttttttccaacaatttccatgctgaacttgtattgagcaagagaatcttgggcatattatcaaaattgaaaatattaaaattaaaagggacatttccagccaaagccaaaaatcctttctgcagtattttggacagatggttgtgtggcccatcctgatcctgagtgtctctaatgaatgatgaagagctcactctttctgctttttttttttggagatggagtctcgctctgtcacccaggctggagcgcaatggcgccatctcggctcactgcaacctctgcctcccaggttcaatcgattctcctgcctcagcctcctgagtagctgggattacaggtgtgtgccaccacgcctggctaatttttgtattttgagtagaattggggttttaccatgttgatcaggctggtctcgaactcctgacctcagttgatccacccgcctcagcctcccaaagtgctgggattacaggcgtgagccaccgcgcctggccgctctttctgcttttaatgaagctaccttgccaccatcttaggagggtttgctgtaaatagcccatcatctaatttgtagtgaagcaaagtcctccttaagaaaaaagaaaacatatttgaatttgcagcaataaaaaaaaaaggaatttaatgaatcatgaccagctttttttttttttgaaaaggaaaaaagaaaaagaagagagtggggtagaatgaagaattagagtgtattatgcttgagaggagttaagtgttgcacggacctttttgtccttcctgtgtgtgcttgtgtatgtatgtgaactggcctgcactaaaatatgcctattactgtggttgtgcaatcagtgtttgaaaaacactcattcgagccatctccatctttttttttttgcgatagggtcttgctctttctcccaggctggggtgcagtggcaggatcacagctcacagttcactgcacgcagcctcaacctctcgggctcaagacatcctcccacctctgttgccacagtagctaggactacagacatgcaccaccatacccagctaattttttaaattattatttgtagagatgcggtctcactgtattgtccagactgggcaattcttatttaaatttagatcttcagcttctttcaaggtcagatctcatctctcacccttcaaagagccttgtcagcctttcttaatgtatatttttaaattttttgaggtaaatttcatgtaacatgaaattaaccactaactatttaaaagtatacaattcagtggtacttggtacattcacactgttgtgcaacaactaacacctctaactagtttcagaacattttcatcacctcaaatctcaatcttttcaccctggaggagtctttgaaatgattttgaggtcttagagaactcctgcataaaaactatatctatagcccatggtacattagcacaatctgtgataataaatatgtaattacataaaaagatgttcaacattatagctattagggaaataagaattaaaatcaagatgagataccactgtatacctattaaaatggctaaaatccaaaacacaataccaattgctcacatggatttgaaataacaggaattctcactcattgctggtgggaatgcgaaatggtaatttcttataaagttaaacacacacctgccatatggccagttccgaatttatgtgaaataaataaattcccataaataattctgggttaaactcaaaataagcacatatcaatttcattttcaactggaatgagaatattgtagctataataatccaataataattgtctttttaaagtaaaaaatggtagttttctgtggatctcttgatttcagccaacttatttacctactctttccctttctcacaaagggttatcaaccctaaagcaagtgggaatgtagaagaggaaacttcaggttgttttatggtaaaattttctacttgatttatttttcctttttaccttatccaagtaggcctaaaagttctctatagtttctattatagagggtgctattgaggaatgatatatggtatatggtatgaacaaaagtagttttctcccctattaaaaactgaaaaggactttttaccagcttttttgagggaaaaaaaacccaaaacagatagttaaacttagcttacctttctttcctttccatacattcaaaaaacttttcagtcagcataatataaacatgttaaataattcaagttatttctgtttatatctaagatggaatttactttttcaaaaagtaggctaagatgatttaatttaaataaaggttgtaaactcgtaattaatgctgttttcaacatcaaaatgtattgacaatgttacataataaagctactaaaactatatgacaaagcattatgagtaaaaatataacctaagatataattttatacaagacttaaaaattaggttcttttactgactgacatgattgggcttaaatataggcagttacaaaattataatcttgatttctttatagacctgtatgtacataacagtcttattttttaaaagctaaaaataaataataaaatttacctctccactctgaaatctgtgtttatattttgccacataaataattccgggtcaagcttgaaataagcacacatcaatttcattttcaactggaatgagaagatttctggccttttcaatacttgttaaacaaggaaagctttgcttacatgtataagaagttgaaaattatagcaaaatggtcattgctctcctatgaatggcaggatgcttacttttatgtaaattttgaactggccatatggtaggtgtgtgtttatcttgataagaaattaccattttgcattcccaccagcaatgattgagaatttctgttattccaaatccttgtaagcaattggtattgccagtgttttggattttagccattttaataggtgtatagtggtatctcctcttttctctctctctcttttttttttttgagactgagtctcactctgtcgcccaggggagtgtagtggcgcgatcttggctcactgcaaccctctgcctcccagttcaagctattcttctgcctcagcctcccgagtagctgagattacaggtgtgtgccaccacgcccggctaatttttgtattttgggtagagacggggtttcaccatgttggccaggctggtcttgaactcctgacctcaggtgatccacccacctcggcctcccaaagtgctgagattacaggcctgagccaccacacccggcctggtatctcctcttgattttaatttttatttccctaatggctatgatgttgaacatctttttatgtgcttatttgccatccgtatatcccctttggtgaaatgtctgttcgtgtcttctactcatatttaattggggagtttccttacttgaattcctgacctcaggcgatccgcctgatgagttttgaaagtcatttttaatatagtctggatacaagttgggtgcaagtctattattgaatgtatggtctgtaaatattttgttccagtctatggcttgaattttcattctcttaaagcaaggctaaaaaatatgtacatatatttaaggataaaatataacatgagttcaaaaactattgttttcaatgcaaattaaggattatagggtttttacttctttgattttatatatttacatgtaatcttgcttcataagtacattagctgaattacttatcctaacataaataaaaatatacaaccatataataatttttaattaataataacattattaacaatttgagttttgaaaatagtttaagatttctttatagctatttctgttgtgagagtatatcccaccaggaatgtatagtcaaattactgggttttagtttcatttaaatcattgctgtcggtatggttaagtcaccaactcagtatctagttaggttcatttgtttcattgtgcttttgtttctgaacttaaaaaaaggcatttgtatggtctcaaagtcaaatttgcaaagtaagttactttcagagagctctagcttttatctctgtctcttcaatcttattctctccctctctccataataacttaaagaaaaaactttatttagtttgaggttatcctctttctcttcctccttctcttctttcttttttttttaatttttaaaacagcaaattgttaaatttattcacatgttccccttttattcaatacttggtagcataatctacacagtcttttgaaccttccttttttcattttaacagtatatcttggagatcacttggtagtggtatatagggctcttcctcatttctttttatagttacatagtactccattttgtagacttacaatagtttattcaaccatccccttttggtgtacagttacattatttccagtcttttgttatccaataatgttgcaataaatagccaaactgtgcttcaaaagacactatcagaaaagtgaaaaagcagctgacagtgtgggaggaaatatttataaagcatattatctgataagggactatattcagaatatgtaaataactcccaaaactcaataataaaaagacaaataggccaggtgcggtggctcatgcctgtaatcccagcactttgggaggctgaggcaggcggatcacctgaggtcaggagtttgagaccagcctgactaacatggagaaacctgtctctactaaaaatacaaaactagccgggcgtggtggcgcatgcctgtaatcccagctactcgggaggctgagacaggagaatcacttgaacctgggaggcagaggttgtggtgagccgagatcgcaccattgcactccagcctgggcaacaagagtgcaacttcatttcaaaaagccaacaaacaaacaaaaaggcaaataatccagttttggtggtatgggattgctgggcagacaaaacaattgctgtctactatgctagatcacaggatagttttgatataaagaattctgtcactttgttcccagtaactattaaaatatccttgaaattacattatttcagattgggccgcttattgaagctgccatccatactttggaaataacatattccattgctattcctaaatgttcatttgaatttcaggaattagagtctctttgcctatgtaggattcaaacacctaattttggtcaccatgcattctgtactgaacttcgtagctctgtcacctagggtacatttgactataagtcacagaatacctgactaacagtggtttaagccaaattaattttctcataagaactttagaggtgtagcagtttcagatttaggcagtgactgatgaatgtcataaagaacccaggctctttttatctctgcattctgccatcttcagaatattggcttttctttcttaggcttgtgacctcatagttgcaaaatagttgcctcagttccagtcatcacaactacatgtaaccatgttcaagacaagcaggaaggagagggaggggaaacagctcttcttatatgagaaaacaaaatgttttccaggagccccccagtagattccctccttccatcttatttgctaaaattgatgcacatggccatcctttactacaaggaatgctgggaaattatcttgttttttttttcaccatctacttttggaggtgggaaagggaaaagagggttcaatagtggccaacaaactttgtcacaccagccacagacaatacctgtgagtctggtattgtcagacttagtagtatccctttcattacaatttgtgtttttaaattatacaagtaacacatgagtatatcaatattgcgaaggataccaagaatactgttctttgtaaactatcttcttttccataatgggaaacaagcctaatactccagttaatccagcatgttcactgtttgtcctttgggtatattttggacttttccactcaattattagtttgtttgtccccttgcctgatagcagcatcctcatgcctcttcctcttcccatctagatcctgaccttccctcaaaacttggctttaatcccccctcctcattaaagccttccccgatcatctcagcaagaaccatctgtctacataagcttgcatgctcatattgcccatttaccgccttatttcctgcgttgtgttttgtgttctttatgtgtgatcgtggcagtcctcagttgactaagaaactgtgattggtggctctttgggttgcccttcacgttctcagtgccttccttacacaaaccgggtccttaataggtgattgtccattgctgcctctacctgcagcaaccatggttgaaacatagatggaaataaacacagcttgggggaatcttctctggaattagtttcctgcttatgtcttccgctgctgctgtggaacaaaatagttcttgttttagcaatagtgaatataaaggatgaagaaagtcatttgcttttgtggcttaaataggagataagtctctcgggatacatggtttatacacagcagccagggcaatatgaagatgtccctatctaaattgtgacacaaagcctctctgtggcctcttgcaccatgctgagggatagttttctctctcttattggcatccagtttgggttttcctggaagcagcaggtttgtctatgcatattcatcagtcaggactcctaaggagaccattctcccctcagtaggattccggctatgctaatggtaaagggatttcttaggccatttcctgggggagtttattctgtttctatagttgcagaaagggcagagccaacttcttgcagaggggggattccctaaagcaaagggtattgagggatgtgcatttttatttcccccttacccaggcccctgggtgctcaaattctacctggtgactccagtgtggcaaagtgaacagcttgaccagctgaatactgaacaaattctttgctttcctaatggtatgtttgacatcccaaaggagggaatggtcaaaacaactagatttttttggggttgggggtggggggaagtttaggtcaattgcatggtttaactgtaatttagactaccttttcttcttcacatgaatttggtaattgaaacatactgttctgttaaattcaagcacagatgtttgtttaatcacttacaggactatttccatatcatttcggttagagtttagtcatttgttgctcagctgtgttcagacctaaactttataaaaggcacgtgagtagagcctctcctagtgactaaggaacgtggaccttctctttccttttttttttaaattgaagtttttattgagataattgtaaattgacatgtagattcacttaagaaagagtacagagaggtcctatttacccctcaccccatttgccccaatggtaacatttttcttttcttttctttttgtttgtaagatagggtcttgctctgtcacccaggctggagtgcagtggcatgatcatagttcactacaacctcgacctccctggattaatcgatcctcccacctcagccccttgagtagccgggaccacaggtgcacaccaccacacctggctaatttttaaaaattattttttctagagttggagggtcttgctatgttgcccaggctggtctcgaactcttggactcaagcgatttgtctgcctcggccccccgaagtgttgagattacaggtgtgagctactgtgtccagctcatttttcaaagctatagtataatatcacaatcagtatcttgacattgatatactccactgatcttattcagatttccccagcttcacttgtattcatttgtatgtttgtgtgtgtgtatttagtctaacctacacatgtggtgcaatgtatacatttccaccacagtaaaggtataaaacagtcttatcaccacagggattcctcatgttgtccttttataaccacacctcgctcccttccaccaactcccccaaccctaccattcctaacccctggcaacaacgaatctgttttccatttctaaaattttgctatttcaaaatgttacataaatggagtcataaagtatgtaccttttggaatttgttttttccacttggtataagtccctgggcatttatccaggtggttgcgtatatcaactgttcattcatttttactactgagtagtagttcatgtatgtatcacaatttctttacatttgcctttggaaggacattggggctatttctagtttttagctattatgaataaagctgctgtgaacatgtatgtacaggtttttgtgtgagcatacattttcatttctctaggataagagcccaagagtgtaattgcgtgttatttgatacttacatgtttaattttataaaaagacaatcaaactatttttgagagcaaattaccattttagattcccaacaatatatgagtgatctagtttctttgcaccctggtccgcatttagtgttatcactatttttattttagctgtctgagaggtgtgtagtgatatctcatggtgggtttaattggcatttctctgatggttaattaattgaatatcttttcatgtgcttatttgtcatctgtatatccagctaagtgaaatgtctgtttatgtctttggctcatttctaattggattgttttttactaagatttatttatttatttatttggagacagagtctcactgtgttgcccaggctagagtacagtggcatgatcttggctcactgcaatctctgcctcccaggttcaagtgactctcgtgcctcagcctcccaagtagttgggattacaggcatgagccaccgtgcccagccttgttttttttactgttaacttttgagaattctttatgcattctgaatactagtcctttgagatgtggtttgcacatatttcctcccagtatgtggcttatcttttcatcctgttaacagtatcttttgtagagccaaagtgtctcattttgttaaggtctaatttatcggtttttttcttttatgagttgtgcttttggtgtcaagtctaaggactcactgcctagccctacatcatgaagattgtctcctgtgatggtttattttgagatggagttttactttgttgcccaggctggagtgcagtggcacaatctcggctcactgcagactcaacctcccaggttcaagcagtcctcctgcctcagccccccaatagctgggacaacaggtgtgcaccaccgtaccaggctcattttttttttttttttttttttgtagagacagggttttaccatgttgcccaggcttgtctcaaactcttgaactcaagagatgcacctgcctcagcctcccacagtgctaagattacaggtgtgagccactgtgcctggcctcctatgttgttgtttttttctaaaggatttatagttttacattttatatttaatgtgatctgccgggcatggtggctcatgcctataatcccagcactttgggaggctgaggtgggaggattgcttgaggccaggagttcaggaccagcctgggcaacataaggggactttgactctacaaaaataataatacaaaaaagcccggtgtggtggggtgcagctgtggtcccaactgcttgggaggctgaagtgggaggatggcttgagcctgagagatggaggctgcagtaagctgtggtcacactactgtactgtatcctgggggacagtgtttgaccctgtatcaaaaaaaaaaaaattctgtgatccattttaagttaatttttatttaaggtgtgagatttaggtcatgatgaacttttttgtcctatagatgcccagttgctcaagcaccatctgttgtaaaggatatccttccattgaattgcttttgaatcttttacaaaaccatttgagcatattcgtgtgggttgtcttttgagttgtctgttctgttccattggtcgctgtgtctatccgtctgccattgccacacagtttttattactgtatctgtatagtaaaccttaatatcaggttcagttcttcctcccactttatttttctttgtcaagattatttgtcttttttttgtttttcctaatatataaagaaaattactctttaggtcagttaataatcttattctgctaaaaaaattaaaagatagcttttagagactgcatgcgttagtttgtaatgctttctcctgaaagtaatggaatacctgactaatagaggcttaaagaagcagggatttatttttttcaccaagtaggaagcctggaggtgttaccagcggagggtgttcaggttcttggcatcgtgaacaaagaattggacaaaatgcacaaacaaagcaaggaaagaattaagcaacaaaagcagagatttattaaaaatgaaagtacactccacagtccgggagcgggcggagcataggggctcaagagcccctttacagaattttctggggtttaaataccttctagaggcttcccattggttacttgacgtagaccctatgtaaatgaagtagtggcccagcaatcagtttgactggttgcggaaagcaaccaatcagaggctgaagtgaagttacaaaggttacaccctatgcaagcatctgattggttgtggaaagcaaccaatcagaggctaaagtgaagttacatagttacactcctatgcaaactttctgcaatcaatcagagatactttttgctttctgcagccaatcagatactttcaattttccatctgccatgcagaaaaaggtgggggtcacggggagattgcaaagggagtagcctcccttgggtctttttgttacttaggtgtggaaagttgtggttttccttttgatttagttctaagaagtcagcgtaaattggccttaggttccctgcctccagaccctattctcttgcttcagaggtagatggctgctggcacatgtatagaggctcagcattgtctcagccagcatttctgcaatcttgcccattatcccaagatggctgctgcagctccagggatcatatatacatttcaaggcaagaagaggtgaatgaggggaacgtgacctgtatctgtcccttggctcaagagagcaaaaatccttcatagaattccaaaacagactcctaaaaagaggctgaggaaacaagtgcagtgtgtagctttttctggagtttttaaatggagacttgcaagggagaaggaatttgggaatggctgcacgaatcagctaccgtgagccagtggtttcaacttactttgggtaaaatctttagaattctgtttattgattggtgccttaagttgaattatttagagcaaaaatatcatagccttatgagaaagattctgcagatctccagatcttattgatttaaattttgtttttcactctactgatttaaatacattattaaatgtataaaatcaatcttattgttatattgagttgatggctaagaatcatgagcacaacactttttcaagttacttttagaaagagaggaaattagcttaaaaaatgtttgagattttctttgacgtgcctttttaatttgcacatttggggttagtttttgagtgatttagcttaattaataagtaatgatggctttcatgctcttatagtcttacattcttagatcccactatacctgaggcaattttgttattttctctgggaggttcacagtatctgctgaatgactttttcttctccatgaaagtacagcaaaaaagaaaagaataaatgaatttttaaaataaatattagacgagggaggaaaaaaccccacactattcacagaatagaagcaaattagtccagaacctgatcaggcagaaatatctaagaatgatagttttagataattctgtatcaaattttctattaacctaaaaaaatagaaaaataagttgtgttaatgtttattgaaatattaaatattaactatctctcttcaattcccaaatttccagtaactgctggtgactgtagagggatttctacagcactctcttttaatacttccccagcttttaagggattgagtctagatccaattatttggtctatttcctcccttccgggtcatggtggatgtttttgctattatatttgccaaaagcaaaagtaacaattcaatcctgatgacttaaacaaggagacatctattacttttctcaaaaagcacaaagaatatgaggcccattgcttaagggctcaggtgttgggtttgcattcctggattcaccacttatactagttgagtgaccttgggcaaattactaaaactctgtctctcagaatccccatctaggccagacacagtggctctgcctgtaatcctagcactttgggaggccgaggtgggcagatcgcttgagcccaggagtttgagaccagcctagtcaacatggtgaaaccccgtctctacaaaaaatacaaaaattagccaggtgtggtggcatgcgcctgtagtctcagctactcaggaggctgaggtgggaggatcgcttgagcccaggaggttgaggctgcagtgagccatgactgtgccactgcactccagcctgggctacagagtgaggccctgtctcaaaaaaaaaaaaaaaaaaaaaaaaaaaaatcagactccatgcataaaatagggatgatgatagaatatactcagagatttttctctctgaggattaagagcattaaaaaatttgcatatctcatttattaatgaggttaactatattttagtatgtttattggctatttccatttcctttttttgcaaagtgccttttcaaatccattgcccatttttctgttgggttttccttttcttagtgtacatatatatgagataaagagtggtctttccatatgtgtatacaatgtgtaatgagcaaatcaggcatatttatcacctcaaatatttatcatttctttgtgttgagaacattcaaaatcctctcttctagctttttgaaaatatataataaattatagttaaacatattcatcctacagtgctacagaacaccagaactcatttcatctatctactgtaattttttatctgttaaccaacctctccccacctcctctccttcccctttccagcctttaatactcccaatgattaagagaatttaatgtggccagacatggtggctcatgtctgtaatcccagcactttgggaggctgaggtgagcagatcacttgagcccaggagttcaagatcagtctgggcaacatggtgaaatctcgtctctacaaaaaatacagaaattagcagggtgtggtagtgtgtacctgtagtcccaagctactcaggaggctgaggtgggaggatagcttgagcccaggaagtcaaggccgcagtgagctgtgatcacgccactgcactccagcctgggtgacagagcaagaccctgtctcaaaaaaaaaaaaaagtttaatgcttctaaagtgcttagaacagtgctacaattgttagctattgtggcaatagaaatgacatttatattggcttatctagctcatggcttatctagtaagctgtcccattcttaccaggcacctcacactacctgcctttgtcttgtggttgtcaagcatctgggcttttgagtgtaggctagaaagaaacaagagactgctgtgctggagttctgaaatagaggttgcaaacagatcaacagctcctgatgtagatgactatagccagcttctcagtttggattaactttacggtttctgtagcggccttgataactaattgattaatcaacttatgcatgtgataaaattgcccttccaatttttagcaacgaggaaggggtgctgattgtagctttgaatttgatatgaagcagagtctggatttggctgccacctttccaacagtggtggaatgggaatcagggagttgagatgccaaggagcactgacctaggatctaggaatagttatgttcctaactttatcatttgctaagacatttgctaatttccttaaattgagactgagtaccaatacacagtcactatggcaaaggcaggttgccatgccatcttaagaggctataatggcaaatctcaagtttttgtaagtgtctgggggtgtgtgtgcatgggggcaaacattttaaataagtgccctatggactgttacatcatatcaaacaaattctcaatgcgttagtttctaaggtatagaattctgaattgaaatttcaagctaatactctaatagtgcaaaaatggagttttgcatgctatgtcaattagaataacaatagcaattggcatcactggacttaaaaaaaagtgtgtgtgttttgttgttttgagtttgaatgtgtgaattcacaactcacaagccaagagttttggagaggttttagtaatagttcctttcatgctaaaagcattgttttaaataattacgtgtggctgattttattttatttagcaagagaattggaaatgattaacaggtatctggataatactctttgggtggagaatttgctcataaatttagctgcaacttggttgaatgaactgcattctgactttgatatattttggtttcttctcaatttttatagcattgttggattttatgggccccacatgcttccacacaactctgttggccttggtggattttaatgtttaaaattaaaaggccccatcatatattcttagttattgttactattatagctggacaaagatatgctggtaagagtttgtagcaattgtgtgtgtgtgtgtatgcaggggttgggggaggtgggtttgcagtggttgctgcccctcaaagaagcaagcatgtagctatccaatgggttcttcttacccactgcccagatagagccgatttctcaaaacagaggaattgcaatagagtttcatacactcagagccagctaaatgggagaccagagttttattactcaaatcagtctccctgaaaattttgagacagaggtttttaaaagatagtttggcaggcaggggcctaaggaatggggaatgctgattggttggtttggggatgaaatcatagggaattgaagctgccctctttcactgagtcaattcctggatgggggccacagatcagatgagccagtttacctgtctgggtggtgccagctgatccatcagaatgcagggtctgaaaattatcttaggttttataatagtaatgttatctatgggagcaattggggaggttagaaatcttgtggtctcaggctgcgtgattcctaagccataatttccaatcttgtggctaatttattagttttacaaaggtgatctggtccccaagcaaggagcaggggtttgttttggggaggggctgttatcatctttgtttcaaatttaaactatcaactcctcccaaagttggtttggcctatgtccaggaatgaacaagagcagcctggaggttagaagcaggatggagtcaggtaggtcacatttcttttactgtcataatttttgcaaaggaagtttcaggcatacctcttttgaccttgttttttccagccccttctctttctcttgcagctgtggtagtgagtaggaaaggaaggttagccttgtggagggctcttgaatttcaatccacctcttcagcctcctttagaaatactagcagaaatgagcctcataccccgtaagatgttgtttaagtgtctgattttgctatttaaggctctctatggattgatttccacattaactcttcaaagttcatgtcccactactataggaaatgcccctgtatctagctgggtctagtcctggtccttcaacatgtttcagtgtcttttactctgcccaaattcagtgcatggttcaaggttcactttaagactcaaattctacatgattttttctctggcatcgactgctccatagtatactcctttgaattcctgtaaccctaatctatatacatagggttggctgtttgctacagtggattgcccaaaaaataaatcataaaaatagatggtatgtttaagttgaagaactattgactcatgcctatcaggccctgtgttaaatgttgaatgtttcttattcagcatttaacatgtggccctgcttccatggaactaagaggaacagtgttaaaagtgacatttaacccaggaatgaagatcacataatttatgtatgttcatggagcaaatattattatggctaagaatgtcataaaagtggagataaatctataaatctatttgtggaaaagaacatataagctcttgggttggttagtaagggagtcatacttggtcccttttttttttagacggagtcttgctctgtcacccaggctggagtgcagtggtgcgatctcggcttactgcaacctccacctcccaggttcaagtgatcctcctgcctcagcctcgtgagtagctgggattacaggtacgtgccaccacacctggctaatttttgtatttttagcagagacggggtttcaccatgttggccaggctggtcttgaactcctatacttggtccctttttattggagctctgactcagttctctctaaaagccaataccaagtccttcctcttgagaaaacaaaataataaatgctaacaggcaggcacaggcacagatattctctcacttagtcctaaccactgtctcgtgaagcaggtattattattctcactttagacatggcaagcctctggagaagtaaagtgactgctccagcatcacatgacccatagaggcaaagctggaaggtgaatgccaggcttctgatgccaggtctcctgtcctatcctttatgaccctattactccctggtgctgctctccattccaaatgtttgattattagatttaagggggtctaagccaggtaacatgaacagggaaagatcagctgacaatatctgattgtttgaaaataatccacagcttatgttctattcattcgatagatgctcattgaacacctactatgtgcaaggccctatagtccttactgtcagaaagtacaaagcctagtataagatgcaagtatataaacaggaaactatagtataatatggtgagtacagtgatggctgtacaggaattatgggtatagaatgaatgaatcaagaatgaaccttgtgagattgtttgtctgtaccactgctgccctttcaaggagcacgtgtattattttttagaaaacattttattctctgttctaggcacttggcctggccctggtgatacagctgggggtgggggaggggaaagggtaagttcctaaatagttaaagagagggtaaccttccagactttaatagaagatctatgcaggaacagaatgttctgcctctggcagtcagagaagactttaagagatgacatttagatgatcttttatttatttcttgcatttttctgagcttgggttattttaaggaaattataaatactagaaactcaagagttttgatttgcaataccttacctagagctgttcaaagagccatatggttcacaagctatttctgtccccatgattctgctgaaaccattctcgtcaaggtcaccagccacctccatgttgccaaatcagggggtcaagtctcaagcctcgtcttcatttgaattattagtagcatttaacacagttagtcacgtgttccttcaaatgctttctttaggtagtttccatgatactaaactctcctggtgttcttcccatcttaccagctgcccctttttagtcttgtttgctaattctaccccatctccctgatcacgtaacattgggatattttaaagctcagtcttggacttcttttctgcactatcatcattcattccagcactgtagccttaaataccatccatcaactgatgtatatcaaatttttatatccagcctcgacttcttgcttgaacttcagactcccatatccacctgctagtccacatttctacttgcttgtctgagtggtatcttgaatgtaacatgtccaaaatagaattctggactcctgtgcctgcctcctacctccagaattctcatttaagttctctcccaccattctacatcccagcacctaaaactccattcttctcgttgttcaggccaaaatacttggggttgttaataactcatctctttttccacaccctacatctaatctattggtaaatcctttttgttctaccttcaagatacatacagaacttgatcacttccactgtctctacttctattaacctggtctaggccactatcatttcttgcctggactattgcaatatccccagttctttgtattgtggccagagcgatcctttctatgccctgctcaaaacaaaatccagtgttccttaaacctctaaggcactggcccctgtttatactcttaacctcatgtctcaagttagaggactctagacctttcaaacaccagaataatgtggtgtcctgcaaggtaaggcctaacaggggaggttgtatgataatccagagtgcaggagtgaatggaggggagaagggactctcggtgactgcagactactgtttcgtgaaacatgaagatagaggatgggagggagtcaagatggtaacgaaagcaagactaagggcactgaaggaggcttttcttcctctaagagttgaaagacttgagtgtctttatgagttcattgaaaggaggccatggaagggagaggctaatgctgttgatcactgacttatcagggacacaagtaagccagtactgcaaggagagacagttaggacccacgtgaatatggaaatcataaattgactgcagtcacttttgtttgcttagttgcatggctttatcccaccacttcactctgtcttctggccagagccttctaattatcttcagtctactaccagcccttttgttatgcctgccagttaatcccagtgccttctcccttgttctgctccaggctcctgaacactgtggatgtgacacaggtcctgagggtcacattgcttcctggatcactattctttgtctcttaattcctgccctcctcccaggtgctttaaacttatctactccaagccagttgcagtggctcatgcccgtaatcacagcactttgggaggccagggtgggtggatcacctgaggctgggagttcaagaccagtctggccaacatggtgaaaccctgtctctactaaaaatacaaaaattagctggttgtggtggtatgcacctgtaatcccagctacttgggaggctgaggcaggagaattgcttgaacccaggaggcagaggttgcagtgagccgagattgcaccactgcactccagcctgggtgacagagtgagactccgtctcataaaaataaaaaaataaaaaaataaaaaaaataaataaaataaataaaaacttatctgctcctgtgacatttgtttgatagggtcagaggctgtgaaactttagaagcatacatgctgtctttggaatttaaaaaatgtatctacatgccaaccgatccattatttacttaatatctctctgtgaattgaatcacttttggaaaactaaaacatatttaaaagggaaactttatatccttaccataaatgaaaaccacatcatttgatctaagtggaaggtcatggtaagaaaaaaagaaatgaaaacaaaacagtgtttttagatttgatgcctacaaaaagttaggagcctgaggcctgctttcttttttataggcaagtatttgggaggtatagtcagtactaccaaattgagactcacccttgccttaatcgaaaggaagaggatagaggaagatgaacattcttgcgcgccctctgaaatcgtctccattaccaactagggtggcatccctggaaagagtgaggcccgggtgtttgtgtgcagagacagcgcaagggttggcatgctgtggcttgcttaatcagtttcagtttaagattggttgaagatcttcatgttaagatatggcagtggcctctttaaaagtcttttgtgcccggcgcagtggcttatacctataatcccagcactttgggaggctgaggcaggcggattacttgagcctgggagtttgagaccagcctggccaacgtggtgaaaccccgtttctactgaaaatacaaaaagagccaggtgtagtggtgggcacctgtaatcccagctacttgggaggctgaggcaggagaattgcttgaacctgggaggtggaggttgcagtgagctgggatcacgtcactgtactccggcctgggcgacaagagtgagactctgtctcaaaaaaaaaaaaaaaaaagtcttttgccttcagaccttcccccttccaacccaccctgcccactgttagtggatctgtcttcagacgtgctgcctcatattgtccctgtgtccctcgggaaactttaatggctccttgttgcctatttgatccagaccacaatgttcaatttggcaaccagtgaatctaccactcaagttttatgggcttcctgtatctgcagcaatatgttagatggtgaggggacatagaaaaaggcagaaatatacaccatggtcccagagtttaaaaaatgtgtcatctagttgagacaaatcaaacacgagtatgtgcacatattatggtgcatgtacacgacgaagggctggtggtcagagaaggcctcatgaatctgcccatccctgggcttggtcatcatatagctcatttgtggtgtgtgaatctcatgctggctggggttttcttttttattgtggtaaaatatacaaagtataaaagttaccattttaaccatttaaattatacaattcagtggcattttgtacattcacaacgctgtgcagctgtccccactgtttcaagaaaattttcatcacttcaaaggaaacctgtacccggtaagcagtcactccccattctttcttcctcccagtccctgccaaccattaatctgccttctgtctctatgaatttgcctattttgtatatttcatataaatggaatcatataatatgtggccctttgtatctggcttttttctcttagcataatgttttcaaggttcatccacatggtagcacgatatcagtgctttgttccctttggcggcagaataacattccattgtatggatataccacaactgtttaaccattcatcagctgatagacatttgggatgtttccaccttttggctattgtaaataatgctgctatgaacatttatgtgtaagtttctttctgtggatgtatgttttcaattctcctgagaatatactgagaagtgcaactgctggatcatatgatgattctatgtttaacttaatgagaaactgccaaactgttttccacagcagccatactagtgtacatccccaccagcaaggtgtgacagttccaatgtctccacatcctcaccaacatttatttttcattttaaaaaaattatagccaccctagtgaatgtgaagcgttatcacagtatatgtatgtatatatgtatttatttttgagacagggtctccgtcgcttaggctggagtgcagtggtgcgatcatagcttcatagctcactacagcctcagcctcgtgagcgcaagcgctcctttcacctcagcctcccgagtagctgggactatacgcatgcaccgccatgcctggctaatttttgtattttatgtagagacaaggtctcaccatgttgctcaggctggtctcaaactcctggactcaaatgatctgcctgcctaagcctcccaaagtattgagattacaggtgtgagccactgtgccaggcttcattgtacttttgatttacatttccctaatgactaatggcattggacatattttcatgtgcttgttggccatttgtatatcttctttggagaaatgagggtcgtggtcaactcagtataccactggaggctatatgagtaaacagcaaactttctcataaatgcagaatgttggcaaactgacaaactgcgtctgccacccagaaggaatgctgagggcagttatgccccaagtgcagtgtttattgtgattaggtacatcagaagcctgttagtaataatatgaacctgtgatcaattaaggagctgaccaatcattacctcctcctccctactcattctacccaataaatacgaagggctgtggaagctcaggggggctgcctttgctcactagaagcagggagctctcttcttccccggacccttcctttaaaacagtttcttttgtcttaagttttcatttctatgttcatcccccttcgttcagtctcgtaatgacggtctcaagtagtaacaatagtaactcttgtaatgacggtctcaagtactaacagtagtaactgttgtaatgacggtctcaagtactaacagtagtaactgttgtaatgacggtcttaagtagtaaaagtagtaactgtcgtggtgacagtctcaagtagtaactgtggcagtctaccacatcctttgcccatttttaaattcaattgtttgtgtttttgctgagttgtgagaatctttatatattctatataatagacccttatatgatttccaaatattttctgtcattctctgggtttctctgttttttagaaatgacatctcactctattgcccagggtggtcttgaactcctgggccccagtgattctcccagcttagcctcttaaagtgttgctgggatacaggcttgagccacctcacccaaacttcattctatggattttttcactctcttgatagtatcctttgacacacagttctaattttgatgaagcccaatttatttttccttttgttgcttgtgcttttggtgccacatgtatgaaacccattgccaaatccagagccatagtgactggcttctattctagggttgggagctgtggcttgcccaaggccatgtccccaaagtctctcacaacttagcacccaatggatgctcaccagatgtttgtagaagggatgactatgtagtgggatgtgagctgacccttggtggggagaggggtttgtgtagaagtatagcctgaccagggacatgactttgaatagacattaaggtaccttataagctgtaagatgtggtctgaccaaagaggagggtacacatgaacaaattgtggaattctgggggacaggtagctgagtgaggccttcaacggtggcaagggctttttccatgtgattatggaaacctagatccatggaggaaacttgtgagtagtggagaaagctcctcaggggaaggaaggctggctgtgacttcatctttataccatactctctagaatagggcctggccggtattaggctttagtaaatattccagtggcctgatgagggagacttttaagatatttacatgagaggcttttcatgatatagtcctccttatatattctactctagctcgccctccttccaaacttgaccttgactttctttttttaccagattcgcccctctcctaggtgctgtcagctcagctgcagtacatcactcctaaccctgcttggaacatccttgcctctcctctcctatctaattcatctcattcctccaggcccaagacagtatccagttatccacagaacctcaacactactactccagcacatcagtgtatggctctagtcagccatacacttagctatacacttaccagagcttagggtcacatgatcttaggttcagatgcaggctccactagttactgtgtaagcttgggtgggccagtctccctctctctgccttggtttcctcattggaaaaatggcagtaataacactgctaaaacagttctgtgacagtgaaatgagataataaatgagatataaaacccttagtaaagcatccagctcatagtaagcggtcaaaaatggtagctgtactgttttctagttgtttgctgtatttggctgttctcgtgttgctataaagaaatacgtgaggctgggtaatttattaaaaaaaaaaggcttaattggctcatggttctgcaggctgtacaagaagtgtggtgttggcatttgcttctgatgagggcctcagaaagcttccaatcatggtggaaggcaaagggagagccagtgtatcacatggtgagagtgggagaaagagagagaagggggaggtcccagactcttttaaacaagcagatctcatgtgaaataactgagcgacaactcatttatcactaaggggatggtgtgaaaccattcatgagagatctgcccccacgatccaatcacctcccaccaggcccccacctccaacactgagaatcacatttcaacatgagatttggagaggacaaacatccaaacggtatcattttatatatctaaatcttgcttcctccgcaagattgtgggtttttttcttcagggcaggggctgagtcttatgcttattttaactcgtatatttggcacaaagttaggactatagtaagtacttaagaaacatttgttggttcgaggtgactttgtgattactcggagttacttgctttaggagacagtatatcattattgaattctatattattctacgattcattttctgaaacccaacttttgctttgttttatggggatctgggactgacttgtggtaatctgattgtatgtgtgagcaagtgtgtgtgtgtgtatgtgtgagagagagagacagagagagagagtggagggaatggtggaggtagcgacaattgattccctaagggacagagccagctacagctcaccatcctaaccactgcatctagctttcctctcccagccctagagctgggctgttatctgcccagggcagctgttatggccctgactcccctggggagggctgctcaggccttcctcattcttccaggctgcctttaccacaaaaggaaatgaggtatttttgaccttatcagacttctctgccaaggcatcatgttttgcaagaggctattgccctggctatatacagtcctgggcagtgtgctaacattaaagaagcaaattcaggataatggttacctctggataagggaggcagggctatgagctctgagataaagcttcagttatctctgaggtatttattttttatgcagggctgtggggcatatgagtgttcatttattatcatgaacattgtataatcttgtatttgctgcttatcatttctatgcatgtattatccataaatattaccgtatttttcgagtattttccagctttacatatgtgtcgtgaaattttatgtgtacttcagctacctatattttttgcctggcagtttttgagatttgtctattttgtttgtttgtttttttgagatagagttttgctcttgttgcccaggctggagtgcagtggcatgatttcggctcactgcaacctccgcctcccaggttcaaacgattctcctgtttcagcctcccaagtagctgggattacaggtgcccaccaccatgcccggctaattttttatatttttagtagagatggggtttcaccatgttggccaggctggtctagaactcttgacctcaggtgatcctcccgcctcagcctcccaaagtgctgggattacaggtgtgagccactgtgcctggcctagatttgtctatattgatacgtgtaatattagactctgtattaatattccatgttataaagagatgtatcttttctgctattgggtagacatttcagtggtttcctatttttcacttttgcaaacaatgctataacaatagtctgatatgcagttccttgtgcctaagacaagatacttctgtaggagtggattggctaggccataggacatatatgcctctctctttgctcgtattgccacatcgctcctcagagtgattgtcctactttaccttcccaccagcagtgcacaaatgttgatgttggccatgtccttgccaacccttggtagttgtatctgtgctttctcctctctctccagatcaccagaaaaggtgggagttaaggtttttcaattaaaggagaatgtcagctctgaagaatttcctgttacatttactttaatgaggaaaagattttgttctctgttttggtgaaaataatgtttagacttctgtggaaaacagttacatacactttttattctgaagcagagcagttttttctttctttctttctttttttttttttttttgctgtttgcattcttggcaaacaagtaggaaagaccaattagcaagctaatgttctaaatatttacttgcagtaacagtcattttttaatgttttatatagcatggaacattaggtttatgtgtactgcttttcaatgttttgaattgattaaaatgaattaaatttaagaatgtgacacaactttatggataaagattgatcataattatttgccactttatttgcattttgtgagggaaaaatacatggtaagaaaatgtgttgacattttacaaacaggttagaaaagtcataaagagtaactttggctattttatgttgtctcttatgttcacaggtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtaagtcacatgacactgggaggaatgcagtcttagcattttacagatgctaaataatttagttttgagaaagtaggagtcttcagtgtaaatgttaaggctagttctttttctttttgccttttctacttattattgcctttatttttagtgttttatttttagtgtttctccctttgtctttatttgtttaaattgacaaacataattgtatatatttatggtgtacaacatgatgttttgaaatatgtatacactatggaatggctaaattgagctaattaacatatgcgttacctcatgtgcttctctttttttgtgatgaaaacactattgtcttacaattttcaaatatacaatacattgttattagctatagtcattgtgttatacaatagatctcttaaacgtattcctcctaagtgaaattttgcttcttttgactaaggttagttcttctgaaaagataaattcaagaacaaaagtatcctaaacaaagaaaaatcattcttgctctgctcttttttatcaggcacattggttgcagaatgccaaatgtttatctttcttggctaatgcttattaacctttctctcatctccttcactggacaggataatctgtcctatagaaactaagagtctcgtcagattgtcacttttgcttttgagttgccattgactaaataattgtgtttgagtctgaatgtggctttaaataggaatagaaaaatgccttctcttcttttctccatactaattagtaataaaccgtagtaatgattccccatccctaagggctaaaatgtgatgtggcaagaagaatagtgaaaggaagtgatgccattattagacaagagttggaattttttaatgtatatgtctatacacatacacacacatatacatatggacatattggcagttagaaaaaggaatgtatttgaatattttttaaaaaggctaagatcagaggaaagaaaaggcgaccagctatatggatatgctgtgtttatcagatagccctgtatcacagcccaatgttctgttctccagaaagaactagttattagattattttagatcctgtaattgaaagatagttcaggactagataaagaattgaaaccatagcatgctaagtttaccaggtggtttttagcagcttttaacatggattggttggcagtactttgattctaattaaaatgtcctcaaattgacacatccccatgtcatctgtgatagggtagatcaattagagtgcacatttttttttgaagcctagttctgacacttatagtgatctaacagaccacagggaggcttccttcctgggaaaccatttctcctttcaacatgggccaatattcttttcttggattattttcagtacctggctcagtgctggacccaaagctcaaaaacaattctgggctgactgacttgggtggattatgcatagttttctgttactctcaatcttataggatgtttactttgcatgggccaaagaaaagattctatttttacctcatgtaaaatagagggtatcgacaatattttaaactaatccactactgaataagtatcgtaggccacaatgtattaatattaaactattctcttgcatttcaagtcgaaaagtcatttcatgtttttctcaatatttaatatgtgcctttcaagcctattttgcaggcctttaattacttatgtagaatatttcatgaatctggaataattttagcttcagactacttgagtaaacgaagagcttgctcatttcagggctaactaaatgcaacataattctttcagttattttgttggtcaacttctattaaatattcattgagctttaaatgagacactaagactgaaatatttacgtgctctgatgagactgtgaactacagactagatcctggttaataccccaagcaaattataaagcgctttctacattagcggttcaacaaaaacaagtcaacacttgttaatcatttgtcttaaaaatgagacattttcagtgcaccccatcccagccgcccggtcccggcccctcactctcctttgccgcgctaccaccatgctctccgtccgcgtcccgctgctgcacattacggacccgcagcagctgcagctctcgccgctgaaggggctcagcctggtcgacaaggtgaacaggccgccggccctgagcgggacccgggttctggccagcaagactgcatggaggatcttccaggagcccgcgagccgaaaactaaagcagctgcccccggcgtggaggatgagccgctgctgagaggaaacccttgccgctttgtcatcttccccatcgagtaccatgatatctggcagatgtatgagaaggcggaggcttccttctggaccaccgaggaggtggacctgtccaaggacattcggcactgggaatccctgaagcccgaggagagatattttatatcccatgttctggttttctttgcagcaagtgatggcataataaatgaaaatttggtggagcgatttagccaaatagttcagattacagaagcccgctgtttctatggcttccaaattgccatggaaaacatacattctgaaatgtatagtctccttattgacacttacatcaaagatcccaaagaaagggaatttctcttcaatgccattgaacgatgccttgtgtcaagaagaaggcagattgggccttgcgctggattggggacaaagaggctacctatggtgaacgtgttgtagcctttgctgcagtagaaggcatcttcttttctggttcttttgcatcgatattctggctcaagaaacgaggaccgatgcctggcctcacgttttccaatgaacttattagcagagaagagggtttacactgtgattttgcttgcttgatgttcaaacacctggtacacaaaccatcggaggagaaagtgagagaaataattatcaatgctgttcagatagaacaagaattcctcaccgaggccttgcctgtgaagctcattgggatgaattgcactctaatgaagcaatacattgagtttgtggcagacagacttatgctggaactgggttttagcaaggttttcggagtagagagcccatttgactttacggagaatatttcactgaaagactaacttctttgagaggagagtaggcgagtatcagaggatgggagtggtgtcaagtccaaaagagaattcttttaccttaaatgctgacttctaaatgaactgaagatgtgcccttattttgctgatttttttccatctcataaaaaaaatcagctgaagtattatcaactagccacaccatgaattgtccataatgttcattaacagcatctttaaaactgtgtagctacctcacaaccagtcctgtttatttataatgctggtagtatcaccttttgccagcaggcctggctggctgtgacttactatagcagtgacaatggcagtcttggctttaaagtgagggttgaccctctagtgagcttggcacagcaggattaaacagtcatttaaccagcacagggagttgaaagttgaaagatgcagcctcactgcttcagcgcagatttcaatgtttacttaaatataaaactggcactttacaaacaaataaacattgtttgtactcacaaggcgataatagcttgatttatttggtttctacaccaaatacaaagcattctcctgaccactaatgggagccaattcacaattcactaagtgactaaagtaagttaaacttgtgtagactaagcatgtaatttctaagttttattttagtgaattaaaatactcgttaaccaactttaaagtcagtcctgtgtttagatagatactagtctgttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttttttttcttttttttttcttttaatacaagaatatgtctctttttattgaggtcttttttatgtgctatgattaaattaaatgagataatgctttaaaagcacttatatgtgggagctaaggtagtattgtaaaacttcaagtcatccttaaacaaaatgaccaacctaagatcttgctcctgttaagtggtgaaatcaactagaggtggttcctacaagttgttgtttattctagttttgtttgtgtgtaagtacgttgtgtgagttaattcatttatatttactatgtcttttaaatcagaaattttttattatgtatgtccttttagattttacctgtagttcatactttaaaataatcacccagtgtcttattctagcattgtctaaatctgagtattatctaggggaatcttaaacttcagtaggaaaccatgagttattcatacagtttccattcaaatattaatttcagaacgaaacaaaatttttttttttttttgagacaaagtctcgctctgtagcccagtctggagtgcagtggtgcgattttggctcactgcaacctctgcctcttgggttcaagcaattctcctgtctcagcctcccgagtagctgggactgcaggtatgtgccaccacacctggctaatttttttatttttagtggagatggagtttcaccatgttggtcaggctggtctcgaactcctgacctcaggtgatccacccacctcagcctcctaaagtgctgggattacaggcatgataaacaaatattcttaatacggctactttgaattaatctgcctttatgtttgggagaagaaagctgagacattgcatgaaagatgatgagagataaatgttgatcttttggccccatttgttaattgtattcgctatttgaacattgtcctgttctattgttagtttccttcatcatttatggtatagtcaatttttaaatctctgtaatataatacattttcctatcttttaagttattgttacctaaagttaatccagattatatggtccttatacttgtacaacattaaaatgaagaaagccaaaaaaaataaaagacgttttcaacttgttgccagtttttccagtagcttttaatcctagcaatatatctagcattacactctcaaataatacaaagtaaaaataaagacagttctttggaaagtgtattaaaattaatatttgtagtagatgctctttgtgcccacccagatccatgctggggtggtgatcccccacccccagctgtgacaaatggtttgacaaacagctcacacctgtaaccctctctggagacttgctcttggctgatgggagttgcatctctcagagacacctgagaggttacactggcccctttcccctaagagggggcagctaataactgatttatcaagggtaaaaaaaggtcagcttccttgcctgaaggggggataattctttgctatgattcaggctccatagcccctcgtgcatcagaccaaggctacacttgacctgagaatgcatccttgcttgcgcggttcatttccctttcctttgctgcttccctcactcccttacaggtttctcccaagagtctgcccttaataaatcacatgcactaaaatccctgtttcaggctctgcctctatggaaccccaacctaagacaacattccaggttttaatccataattctgaaagcaaccaccaaaatgccttgctcaagtagactatcacattacaagcagagaaaatgccttttgcaatcatgaaaaggagccagtatttgttatcccgcatggcccctgcggcagacacttctagctgtttatcctttatgcattctacccttccttcttataggcagaacggttttatgcaggctggaattgtgcccacttaaatgtgttacctccccaggctccttgcagctagggctggccgcatgactcacttttggccaatgatatatgcattaagatttattgggtggggctcgtgggagagttactatttttctaatgaaaacaggctcagcaggtatgattttcctaccctttgccctccttttgtttttcctgtctggaactagtgttaccgaaccaaactgggtccatttacctgcatgcaagggaaagccaaacgccaaagcaccaggtttttgcagcaagaaaggtttattgagttgattggcaaggagacaggaggaaacactcaaatctgtctcctggagctgggggctgggtcgggttttataagcatagtgtaatgaggtgtgatctgattgcatcttgcaatgaggtgatgctgggaggcataatctgattggatcctgctatggggtgacaccagagcacgatctctttggttcctggatcctgccatatggggtccacttcttaattcagtccctgttccttggtccaagcacttaggtttcacctgtgcacacttggttcaactgggcatgctcgggttgtatgaccttcaaccctggggtccacggcaactgaaaaacaactcacgattttgttttataaaagttgaactagattagtctggtgcggttacactaggacataattcctagggcacagcagctatcttgtgagcatgacagagataaaggaaacctaggtccttgttggcatcatggagccactgtttaaggcccaggctgcctctctttggacttgtagttatgtgagaaaaatcaggctatatttcagagattctcaacctagcaaggtatttggaaatatgtggaggtgttttgagttgtcacaatgatcaggagcagggccagactagggtaaggcaaatgaggcacttgccttcggtgcaacatttggggtgccccaaaactcagcaattaagctagataatattttattatctaattattattattatctgttattaagctagtataatattttaaaaaatcaaattaatgccagaaattcatgatgaacaaaatgccaacattttaaataaagacaagatcagcaactgtgccatggaagttatattggagcctgaggcaaaaggaaaaatcagtaatactgatccaatcttcattaaaaatttggcattttgatattttgtttctcctggatattttgcattaattttgttttattttattatttttttttgaggcggaatctcgctctgttgcccaggctggagtgcagtggcacgatcttggctcactgcaacctccgcctcccaagttcaagcgattctcctgtctcagcctcccgagtagctgggactacaggcacccaccaccacacccggctaatttttgtatttttagtagagacgggatttcgccatgttgaccaggctggtctcgaactcctgacctcaggtaatccacccccctcagcctcccaaagtgctgggattacaggcatgagccaccacgcctggcttgcattaattttgatgttttaaatcgcctcaccctagggccagccctgaccaggaggtgctgctaccattgagtatccaggggccaagtgtatattttatatcctgcagtgtggggaaggcaaccctacattggggaaaaattgttctacctcaaatgccaatactgtttccaccgagaaacacagtgtgtgtactacttgcttaaaacccgtagcattgggagaatttctaaaaacaggcaaaagaattttgcttaatactgcacccacccttcaaagacttcgttatttcattgaattcatttaaataaaagcagactatgatggggccaagacaaaaacaagactattccataatcataactgtctgaacacagaacacgaacactgtccaagtcacaaaatgcatcactcacgccagttatttccagtcatcatcccagtacctccatgagtaggaagcaaatatagacggttgtcctcatcatataaatgaagaatcattctcaaggagaaatggagcaggaaccagagtctgagactgggtgttggaggcactgattctggttctggtcccgccattaactatatgtgtgattgtggcttagtcactttacctctctgagcctcagtttccttaactataatgcaggacttggctagctgatctgtaaggcccttttacctctggcaatttacgtctaaaacttgactaaagtcaaattcagcttgtttatcctagaactgagcccagaccctggatctaatggcctaggactctctaattacatcaggcacccactacttcattattaattgaaatttggcatttagcagtttatgctacgctatggtggctgtataagatctatagttagctgcttttataaaacgttggaatatttagaaatatacaaatgactgaatgtttttatatgactttcgtctggaagttaagccccatttacatagactctacaattttgctctcatttttcatttgtcaacagctcctagttagcctaatttgtttgctatttcacaaatgactcagttatagtaagtggcaagataaaagttgatcttatgggatatgcatacatttgaaaatattatttctttttttttccatctattgtaaacataatggttataatcaaaactactgaccgcacaattgaattttaatcacttacattaattgacatcgagcttgtaatgagctgattatttatgtagctgattatttatgtagctgtgtgactctatgatttgaacaatataaaaataaatttttaaaatataatttggtcccctgggtcatcttgatttttttttttttttttagattaaacaagttagtttattattcatttgcagcaagggaaaaaacataccctaagcaactgtgggatgtctaatgaagcaggtgttagaaaaggcttattataggatttgggcttgtgttaagtaattgtggggagtgattaaggaagcagggctttgctctggattgggtgctatcaggaagtaggggtacatctacaactgggtatcttaataaatctcagagggagagaacagactagagtgagtctatacctataattgggagagaagcagctgtcacttctgtgagccaggagagggggatgtttgacatttcatggctggacaaggttcattttctgtgtttagatgtgactgtggagtggtcttggttttgtcttgatccgtcacggtcacagagtggccttgtctgatgttggtggtctctgaaattattcttgtttagcaggagaacaccaaggcctagctgtggatgccaggccagcttgtaacagcaccaagaccagctgatagtataggccggctcctggatgtcaggggctacttttctctttcttacccagtactagctagaatttttaattttcctgcggtaggattaacgaatgatcaggtacattataatttcacttgcttaacaaagaacaatacgtaaatacagattcttgaagttttgcctaaagccagttaggaatgttataaaatataatcagaatatataaaaataaaatacaattaagcttttaaaaaaactggaaaatacattagatataccattaaaccatacccgaaatttcaaatggaaatctttctataggtttatataattctcagattatctgactcttgctattaccatgtcataaaagacaccaacatgtataattataagacaacgtaattgcaatacatttgccgttttaatcccatgttttacatcacaagtacacagatcttcagctatttagttttagagaagaaataaaaaatcttgcctgaaatcaaccatgtcataccccaaattctcaactatgcattctgcatttgtcactaagaataaaacacttagtctttaaatttatattaaagtgataaagcttccaatttcattgtattatgtaggtttctttaatcttcttttgaaattcaaaaggcacttaataaaaataatccccaagtctggaataaatgtttttggaataaaaagaatgagaatcataaatgagccttttactaaagaagagagttcttccttccctcttttctaaaacctagaatttagctatttgacaacattttaaggcccttccctcaggccaaaactttttatcagtaactaggcctgtggcttattctgattagtccaaagttaaaattgtctttttgaactttaacttttgtaggtaccactacatccccattagaatggctataattttaagactcttaccactaagtgtcggtgatcatgtagagaaactagaaccttcatacattcctggtaggaatgtaaaatggtgctgccattttgaaagacagtttgacagtttcttagttaaacatatacttgctgcatgacccagtaattccacttctatgtatccatctaaaagaaattaaaacatgttcacacaaaaacttctgtgtgaaatgtttatagcatcattattcgtagtagccaaaaaacagggaacaacccaaatgtcccttaagtaataatggataaacaaaatatggtatatctacataatgaaaactatacaacaataaagaaacctaatgatatatatgttacaacatgggtgaacctcaaaaacattacactaagtaaaagaagccagacacagaagacttcctattatatgattccatatatatgaaatcctagaaaaggcaaatacataggaaaaagcagatcagcagttgactggggctgatggtgggagaggggacttttgtgggggaagtgatagaaatgttttaaactggattgtggtgatgattacacagctctgtaaatttacaaaaagccattgaactgtatgcttaaaagtagtaaattttatggtatataaattacagcttaaaatattagtttgtttgggttgccattgtaactgcccaactggttcaccatgcctgctgcctagacagagcccatttatcaagataggggaattgtaatagagaaagagttattcacacaaagctggctgttcaggagaccagagttttaatattactcaaatcagtctcccacaaaactcaggaattgggttttttaagtataatttggtcggggggggagtgggttggaaagtggggagtgctgattggtcaggttggaaatcatagggagttgaagctgtcctcttgcactgaattgttcctgggtgggggccacaaggccagatgagccagtttgtcaatctgggtggtgccagctgatccattgagtacagggtctgcaaaatatctcaagcactgatgttaggttttcctttttttttttttttttttgagatagagtctcactctatcacccatgctggagtgcagtggcgtgatcttggctcactgcaacctccatctcctgggttcaagcgattctcctgcctcagcctcccaagtagctgggactacaggcgtgtgccaccacgcccggctaattttgtgtatttttagtgtagatggggtttcactgtgctggccaggatggtctcgatctcctgacctcatgatctgcccgccttgacctcccaaagtgctggtgttacaggtgtgagccactgtacctggtgatgttaggttttataatagtgatcttattcatccccaggagcaatttggggaggtttagaatcttgcagcctccagctatatgactcctaaaccataatcactaatcttgtggctaattcgttacttctgcaaaggcagtctagtccctaggcaggaaggggttgttttgggaaagggctagtatgtttttgtttcaaagtttaactatacactaagttcctcctgaagttagtttgacctatgcctcagaatgaacaaggacagcttggaggttagaagcaagatggagttggttaggtcagatctctttcactgtaataattttctcaattatgatttttgtaaagacgatttcaccataacaaaatactacagactgggtggcttaaacagaaattttttttctcacagttctggaggctggaagtccaaggtcaaggtgctggcagggttggtttctcctgaggcctctcttcttgtcttacagatgactaccctcttgctgcctcatcctctgtgcacactaattatagttattttgaacataaaatccttgtcatttataagattttagttcacaaattaggaagaaactgatagtcactatttgacttgttgacttaaattttaggctgatttatattttgttctgaacttttaatctataaaagtcatggttatttatgtattcttcccccccgagttcaaaccagctgcaagtttatttgaaatattaaaaaaaaaattatttaccttcctttattttgtatttgcaggactctgccctatggtaaactcactttttgtaacgctgatggtgggtgatagcacaaatgccatagaccatataatctagctgtattcttaaaaaaattttttttaaagtaattttggactcacaaaaagtcacaaaaatagtacagagagttcctgaatacccttttcacagctttccccgatgataacatcttatataacagtttgatataccttatcaaaaccaggattttaccttctgcaacatggtaaaacaagaacaaaaatgcaggaaatcagcattggcattgtgaaccccaaagtatctgagacaggtctcaatcaatttagaaagtttattttgccaaggttaaggatgtgcctgtgacagcctgaggaggtcctgacgacatgtgcccaaggtggtcggggtacagcttgctttcatacatttttagtgagacataatacatcaatcaatatatgtaagatgtacattggtttgatctggaaaggcgggccaacacaaagccggggagaggcttccaagtcacaggcagattcaaagattttctgattggcaattggttgaaggagttattatcaatataaaggaatgtctgggttatgataagggcttgtggagaccaacgttttatcatgcagatgcagcctccaggaagcaggcttcagacagaatagattgtaaatgtttcttatcagacttaaggtctgtgttgacgataatgctggtcaacttttcctgaattccaaaagggaggagggtataataaggaatgtctggttcccccttcccatcatggcctgaaactagtttttcaggctaacttgggaatgtccttggcctagaggagggatctgttcagatggctggggggcttagaattttatttttggtttacagtataatactattaactaaaccgcaaactttatttggatttcaccagtttttacatgcactcactttttcccccttagtttaacagtcctgtggaatcttatcccatatatagattcatgtaaccaccaccatgttcaggatacagaataactgtgttctttaggattttgctgtttgagtcctcatttattgaggtaaacttcattttaattcttaaaatcaactttattgaggtataatttatatgtaataaaatgagcctttttttttttttttttttttttttgagacagagtctcactctgttgcccaggctggagtgcaatggcgcggtctctgctcactgcaacctctacctcctgggttcatgcaattctcctgcctcagcctcccaagtagctgggattacaaacgcccgccagcacgcctggctaatttttgtatttttagtagagacggggtttcaccatgttggccaggctggtctcgagctgctgacctcgtgatctgcctgcctcagcctcccaaagcgctggcattacaggcatgagccaccacacctggccaaaatgagcctattttaagtatacaattccattagttgtgacaaatgtatgcatctgtgtaaccaccaccccagacaccgtctagacgtctctgttgcctcaggaggttcccttattcccccaattcgtttagccctttcccattgttctgacttctatcaccatagcttagtctttcatttttttctcagatttcagataaacggaatcttatggtgcatctgccctggaatctagcttactgtttgagatttaagatttgaggcgcagctttgacaatgtgtatataaacaaagtgtagcaaattcatgtaataatatactataacagatttctgggcattttacagtcctttttagtcctctggtttgatatccctttactttaaaacattctgcttcagttttttcaaattactcttctaacctccttcagaggttttaaaatactttaagatgttaataacaccacattattcaaagatatgaagaaatgcttatctccattcttttttcaatgttgtcccatttccttttcttttattccatctctctcaaccttcttgtcccttcccttctggtgttttttttttttaattttatttttatttttatttttttaccttttttctgttttcttttctcttttattggacttctgtctcttcatcctcattctctttactttcatccatttttattcatcttctattgtgagtgccctatttaactttcttcctttccttactttgtcttcgcctgtttctggccttgcagttgctgacttctcttcttaggagagtatcatcattgttgtcatcatcatcatcatcggttttttttttttttttttgagatggagtctcgctctgtcgcccaggctggagtgcagtggtgcaatctcagctcactgcaacctccacctctcggtttcaaatgattcttctgccttagcctcctgggtagctgggattacaggtgcacgccaccacacccagctaatttttatatattttttttagtatagatggggtttcaccatgttggtcaggctggtctggaactcctgacttcgtgatctgcctgcctcagcctcccaaagtgctaggattacaggtgtgagccactgtgcccagcccatcattgatattattattactagggcctttccccttcccctttcccctagggctggacccagggtatatatgtctctccaaatggagtgttgtctgaaattaactctgtgtgcagtgtctagggtgttctttggaaacatggcctgcctgcaatacctccttaatgagaggctctttggtatagtagaaagaacaaggcttttcagttagactgaggtttagaacctggatttaccatctattacctatttcatcctggccatgtttttaacctctcttagcctgaattccctcatctgtcaagtgggaataacaaaacccaccttagagttgccgtgagtatcaaatgggtaatgcatgtcaaatgcccaggtcatagtagtcacgaagaattatttccttacatggggtggggagagcagttttcctaggggaagtgaagcataagctgggactatcccaatgctcatttgtgctacaggattcttgcatttttctttgggaaaaattctgggattttccagaagaataaatttggagatgctaccactgagcccagtgagttctaaaaagcagctattaagctatcattgtattgctctttccaattgttctgggcaccatttatgttgaaattagggtagttcataaaatcatatattgtttaaacaaaagattttgtcatgtctcttctattttagcaaatttacttaatggtcttttaggaggaaaggtgataaataactaccttttaaattattttattttttcattattctgaactaatagcagtcagtaataggctgctacaactgtatttacatgcctattattcataactgtactcatagattttataccatgatcctctaggttctagaaatttcatgcaggtccttttatgtttagttgaaattgtacttcctttgcagtctaccatgttcccccctttttttggcttaaaatatgaaatatgttttgcatgcattttattatttctctttgattctacttgttgatatttttcattcagaatttcaaagcatttatttttgcatttatatttacatatcaaaaatatcatattttaatagttttacatattaaaactattttcagttctggtctacttggcttttacagtcagctttatgaattgaagctttggttcttatgggtaggtaatggagataatattattgtgtgttcccagctttctccttttccacataccctgcctgctaaacaaaaatttgtctttgctcactccacttttctccacctccatcctctaaggattcttctgactttttcagttgttcttatgctttgtgggatataggaaaggaagaagtggataggagggagagagagtatgagtgggagagcactgatggtgatgaaatgtgaaactcgtgagaatcgaaaaagagagaaaaggcttttttgggggagaagtgtggatgtgcagcataaattggatcacctttagattttccttggaggtctaagtgaagatgaaacaggattttcaattgctattagttgctgggccttttctttgaatatactaccatgctgagactaagccacactggcttattatttgagttacttctaaatgttaacttactaaatgatatatttttgtgtatgcttacacaaataagagaactgccattacccacccctctcccaacactgatcagttgacctaagtcctctcgtctccctctgaaatctccctttcatcagtctgcttctttccatggccactgctgccatcctagttcatctttcacctggagagtagcctccgttgaaggcatccctgccttcaatataattccctttctcaactgcccactctgctacagagttaactttctaaaatgtttagactcctttgacctcctttgcatggcttagggaccacctatattttggctcttgtacctttgtagtctcatctcctttgctcccccatcaccactcaacccttagccacacaaaatgacttgcagtaccccacataccgaacactcctatgctcccataactttgcacatgctgttcccctttgcagagaatgcccttcccttcttgtccacttactccgtctttcagcccattgaagacccatttcagatgttacctccaccatgatgccttctgcttaatactttcaggtgactggcaattccctctccttttggagcattttcataaacccttattactcttctctgtgtcctccactgagcaggagtgagtggagattttgtggcagttcagggcatagtggttaagcttgtggcctctgaggctaggcatcttgtgttcccagctgtctcattctcttactttgagactgtgtgtagattacttaacctcccaaatcttgaattctataaaatgagaatcacagtattacctactttattggtgttttgtgaggagtaaatgagataagagtataaaagtacttaatacaatgcctgacccattataagtacttaatcagtgttggctattttatttagctttgaattctcagagcttagcacaacgcctgacacatggaagacaacttggcaatatatacggagctacaatattattaagtctttcctaatggcttttagcttttatctccaatgcattatcattatttggaggtaccatactctgttttgcagttatttgcatatagtcttattccccttacttgactgtgtactctttgtagctggagagattgtcttattgagtgttgtatccacagcacagagctttgaacttagcaggtattctgtggctggtttggtttgtattattttccattagtaatggaagtacccattttgtgaccttggttggtgatgcacttgtgggaaataaataacatactttgggatcattaaaatcccattaaaatcatccaatgtactgggaggtccaatttattgggtaattactagaattatagaacaaattctttggactggaggagaacataaagggcatcatatccaagcatctttcttctgactcttttgcatggaatccagcttttaaaaaatattgcaaaatgatggcatgaaggagtgtttttgccttggttctcatattattcctgctaattttacacacacacacacacacacacacacacacacacacacacacacacgttgagtataccaaatctgaaaactttttgagtgctgacatgatgccacaagtggaaaattccacacctgccctcatgtgatgggtcacagtcaaaacacaagtgcacaacacagtttattcagcatcccaagggaagaaaaagcccttccaacccccttcacctacagtatagattctttgcacatgtccagattcccccaaacaagcatgcctacaaagtgtaataaaatggcacatgtgcaggctggatatgccaacggcacgttccccacaattccccgtgtaggaccaagaccttcgtgcattactcattgtgtatttttgcttattctctgctctgtggtgtaaagatattgttgaaaatgtcaaataggtctgaagatagccctatgggtaagaggaaggatttatgtgtatccatagcatagaaagtcaagctgtgggagaaactggacagcagtgtaactgtgaagcatcttacaggagagtatggtgttggagtgaccactatatatgacctgaagaaacagaatgataaacagttgaagttctatacaaaagtgatgtatagaggttattaatgaaaaatagaaaaacagtgcataaagctaaaaatgaaggtctcaaacatgtattgaaagagtgagtccatcagtatcacagtgaacacgtgccatttaatggtatgctgattatgaaacaagcaaagaaatggcaaaaattttgccattgctttcaatggcaaaaactgtaattatttttgcaccaacctataatagctgaaatggttctaaatcaaggtgatgatgaagatgacattgctaactgtaaaaaaaagtgcctatagatgatgtggtgaaattgtgatgggattattggatgactagagccatatgcatccataacagaacaagaaatcatgtcagttgataaaatcaggggcacttataagacaaaaacctctattaatgaggctgataactctggaggaaacatttaagaaagccatccagcagaatgcctcctcatctctagaggacctacttcctggtccctcaacttcttctgatgtttcttctcacctaaaaaaatagagtgtataaattagctgggcatggtggcacgtacctgtaatcccagctactcaggagactgaggcaggggaattgcttgaacctggaggtggaggttgcagtgagccgagatcgcaccactgctgcactccagcctgggcgacagagcgacactctgtctcaaaaaaaaaaaaaaaaagaaagaaaggaaaagaaatacctgagactaggtaatttataaagaggtttagttggttcatggttctgcaggctgtacaggaagcatggcacatctgcttctaaggaggcctcaggaagcttccaatcatggtagaaggcaaagggggagtgaggcacttcacatggctggagcaggaagaaaaggagtggggaggtgccacacacctttaaacaaccagatctcatgagaactcactatagtgaggacagtaccgagggggaaatccacccccttgatccaatcacctcccatcaggacccacctccaacattgggaattacaatttgacatgaaatttgggtgggtacacagatccaaaccatatcacatgtgaataagtgtaagaaaattattgcttatccaaagcatataaattcagtcaggaatgatgattatgccaaataaccacagattgtccatatgagtggctgagatagtgacacctttgctttctgatggttcaatgtacacaactttgtttcatgtgcaaaatcattaaaaatagtacataaaattatctttaggctatgtgtataaggtgtgtatgaaacataaatgaatttcttatttagacttgtgtcccatccccaggatatctcattatgtatatgcaaatatcccaaaatctgaaaaacatctgaaacactctgttctcaagaatttcggatatggggtaccgaacctacatatgtacatacatatgtgtttctgtgtgtgtgtgtgtatgtgataaatgaaaaatattataaaagataaaggaacaatcatatatgtatatatatacacacaaaaaaacacacatatatataattttttatatggtaggtgtttttcttttgtatttttcatattgaatgtcagttttcttgattcagtttataaaactccatgattagcaatgtgatttctgcaggatagggtgaccccctttcttctagtcctagtatcatttttccaggaagtctgattttaaacagtggtttggaatctcttctcttagtaatatcaagtgttttttaattgcttgcgcaatagactccataaggatgtgaagactattttagatatggttttgacagtattttcaagcttccagctttgcatcctacactgatttatatattattcagtatttttatacattcattttctctccaaagctgttatatatacataattttcttaattctttaaatagtgctgtggttatcactgtggttagcaagtgttgattttctaatttttgctgaaaggttaatcagtgaacaaagagcttaagtggtttgtaccagtgatgtagttaattagtgataaagctacgtgaacattctagcattctagccacttccctttccattttcatgcatcataaaatcatgtcttatgcagacaagtaaaactaaattttatgaatgcttatattgcccatacaggtgcattttatcttaaaccatagatttagtcatgaaaacttgagtatcgattataaataggtttatgatatttttgtaatacaaaaaaattctttggaagtcatccctctgtaatttatcttttttgttattcatttatgcaacttacctttattgaccatctcttatgttcaacatgctaaatgagattcaggtttgtataacttgagttttcttaaaataagatacgcctatataaacacagtatccataggaacataaatttatcaaaaaatgaagtgagaggaaaaaaataagaatttggagtgagattataacttgagcattggtatttagatgtacccccacctccacaatcccaattgaaatcactgcaaaattttaaaatgtggagaaactaaattcatgctggaggccagggaggtgttccaccttcatgttgcaaactttgaagagtttccacctgatatagtgcagatgggatgatactgaaagaatatacccaaacgaacttgcaatttcacttcccgagaaagtgacaagaatcgagttgggggttaggacaacctgtaggggtttccacatggtttactttcacaactattgatggcttaagagtgtcactaggagacccagaaatatagtcacactgaagtcaaagcaggccctgcattcgggcttttctctgatggaacaggcaacggcatacaaaggactggccactcttcctggagtggaggttgggtcaactcataaaatgtttatatggaaaattagaagtttttcctgctggggactacccatggttccagctcccttcctacttctcttgaccactctacatgaatttatattaaccagagaggaggtatctaagaacattaggatagatggtgaagggagtgaaagaaaacccacccacccaccctattttgtggaaaacaccagcctagatagactgctctttgttcaggaatgaacaaagaaacttaaggtttctgaaaagattctacaacataaatggagaacatagtattcaagaggcagaggaagaaaaatacttattttaaaagtatgttttctacagaaaaaaataagtatttttgataacaatgtgctttgtgtaaggaagtatataatacaaagtgagaagtaaaagcaaattaaaaatattattgaatgagactgcaggcaaaaagtcaaagggagattgctgaagaaggatgaaatgtgaggaatctaaaaatgcattatatgtagtaaagaaaagtattaaaactggggagaatgggatgagtgatggaaaaggtaaacttgagaaattctcctgaaatgcaatggaaaaagataacagagcaatgagatgatggcaggttggacagaggattgagctctaacatgcagacaattgttcctaaagaattaaagtctagattaaaagcaaccaaattgattaagcataccataagaaaacaatacaaacaaaagcaactttctggattacagaaagacgtagaccgggccgggtgccgaggctcacgcctgtaatcccagcactttgggaggccgaggcgggcggatcacgaggtcaggagttcgagaccagcctggccaacatggtgaaaccccatctctacaaaaaatacaaaaaattagctgggtgtagtggtgggtgcctgtaatcccagctattcgggaggctgaggcaggagaatcgcttgaacctggaaggtggaggttgcagtgagccgagattgcgccattgcactccagccctggcgacagagtgagtctctgtctcaaaaaaaaaaaaaaaaaaaaaagaaagaaaagaaagatgtagaccggcagataaaatacttattctgtaccagagaaaataaaaaagagatcaataattagatctaccctgacaaattttcaaggataaagcaaggaaattaccaagcatcaggatagaaaaagtaatttaaccctcaaaggcaaagttgacattggaattctcagcaatactaaatgccagaagacaatgaagccatgtctataacttttaggggaaaatgtgactcagaaaatctaaactcagccaaggtgttatcattagtgaaaacagcagtaagatctcagttatataatttatcactaatatgctatccacatacttttcctgaaaaagttgcttaattgctagtcaattaagagataaagcaaattaaacagttcaaccatggggaggtcatgaaataaaatgattagtggtgagtagtagaaagaaacatatataataggtcgtgaaatataaataaaattcaaaacataacataaacattttgagtatttattgaaagataaaagaataacaatcataaaatgagccccaaatccaagatagggatagaaaaaaaatatgaattatttagaagaatatgcaatttaacaggctatatggtcacaactatgtcaaggaaagacatcaacaacagtggggttctaggtaatagaaatgccatatactttttcctgctactctctatttccatatttttgtaatacgtttgtatttttatagtgtgtaaactttatcaaattaaatctatgtatacagcagagttataattacagacacatttgtagtattgactgctttgttattgctctccaaattaaaaataaactaagcatttagcttaagacattaaaaaatacacaataaaacagacatcagagaacaaaaagaaaaataaatttcaaagcacaattttttgtatcagtaaacaatagttttgaaaaagcacatgccgtctgagttgagtatttaaaacaaacagaattaaacctaaacaaaaaatacagaaaacaatgtatttaaatcataaactcagagaaagtaaaatgtatagctatgctaactatgaagtgaatagtattaattagcaaaattgacttaagtacaatgctggaattggccaatatatggaaatattagagaaaactgccaaagagctactccaaatgttagtgattgtctctaagtgggtagcattatgggctattttactccctctttgtgtgtttttttttttaatttttactttttacttttttccccactacaagctactttaattctttgaacaatttttccatgcgggtaaactgttaccatattttcctattaagaaatattttcaatagattttttttctacaataaattttactggaaacatttggttcattaatttttgtctatatgaatgctgtccatcatggcttttgacaatctgagttttttttgatgatcacatttctaccaaaatcaattttcctaagtcaaattttgtatatccagattttgtaaatatttgactcttctattgatttttaaaaaatcaattttaccatgtgcatttttccttctgttgcttttattttgtttgggtttttaaaaaatcacgtttatttttttgcttgtctcaaaaatttttaataagcaggtatgaattttgaagttagatatgaataaaaaccaactgaaaaagcaaatccctctgtctcccaagacaaagtgggcagtttgtttcttttgagctttaaaggtagaaatagctgcctttctaaaatttaagtgaagcgaaatgttgacatgccctgaaaggactgccaaggttcagggagcctgttaatgggccttgagaggctctgtgactctggactaatggcccagggaccactaagagtaaattgaatttctagattactggctactttcacagctctctgatgcctccaggatgggagagtagacacaccaaatgccagaaaaataaatgctaaataataattcttcgaggttcaatggaatatctatcacttaagtagcaaactatttactaagtgtcccaaattttgcacatttgcattgcaagattttactagtaacatgagtaagtgaactgttctttacctcactcatggaataagtaaatgaaggttgtgctttttgatttaggccactcttgatatactacactcagaactacattgctcactccccttcctaaagaaataaaggtgaattgcaacaaggttctctcctgcatgttagaaacactgcagagtataatacttgcatttgccacacagaaatgcagggagagaggagcaggttggaaaagtagttttctcatctaaaattaaaaaaaatttttttgatagaaaaattttttttgaaaggaaaactcattgtgtgtatatcttgcttaccttgttgagtgtatacttacattttttatttaaaaaatttttttttagaaacgaggtttcactatgttgcctaggctagtttcaaactcctgggctcaagtgatccactcacttcggcctcccaaagtgctgggattacaggcgtgagccactgcgcccggcctatttttcattaaaaaacttttttttttttttttttttttttttttagagatgggagtttcactctgttgccaggctggagtgcagtggtgtgattatagctcactgcagcctgagactcctggattcaagtgatcctcccacctcagcctcccaagtagctggaattacaggtgtgtgccaccacacccggctgttgttttgttgtttttattttttttttgtagagacgaggtttcactatgttgcccaggctggtcttgaattcctgggctcaagtgatccgctcgcctcggcctcccaaagtgctggaatgacaggcgtgagccaccatgcccggccgatttttaaatttttttaaatagaattcctataatatacaaatataatacacaaatcacctacctcacttttaaaattctacatttttttaaagacaagtaggagggtgactttattcaccaagcgatcaaaagcaggctgcagaggacagggatttagattgggaaactctttgtattctatcaagctgtcttctttactggctaccttaaggcatttttgctgggaagaaaaaccttaataacatcaagggcagtttaccttaaccctcctgccatcccattgtaccccaccctaccagccagaaacagaagtcttacgaaaaggttttgaggaaaatatcctgtcctagtttactccgttccaacgaattcttcaaacacatccttgacccaggacatacgcagagttcaaatctagtctgtatgttttgttaggctaccggtctcctttcttgggaagactcctgactgtgccttttctgtttaaagatggtagaggcgatgggtgttctcccgcaagacggtcaaggtgtgggagagcgacacacctttgattctggcaatctctcgcacagtatgcagggccaggcctgggtgggcatactggcaatagcttttgggaacccagcgagggaggaagaagggagcatcggtttctacaataattctctctagcgggatctttctcacagtttctcgggcttgcccagcagaagagtaagtcagaattgccgtgaagcccacatacaggttgggaaagtggttcaacaggggctcgatgactgagtaactcccagtgaagcaatggcgatgtatcttgtggtcagagggcacgtaatttttcaagatgtgcagtaggtcttcatcggcttctcggcagtggatcatcatgggcttctttagagagacggccagccgcagcagtctcttaaatactttctgctgctctgggatatgcgtggtgcacttactggagtaatccaagcccatttcgccgaatgccacagccttggggtgtcgtaaggcttttaaaatacttctttcttgatagttgttataataatgggcaaaatgagggcgacagccaaagaccccccaaaccagatcatctttcaactgatcctcccacaggttatcacttaggttttgaggattgcagaagcaagaaatgcagccctgaaactccttggggaaggtgttgctataaatttttctgaatttggtaaaggtgcctttgaaaggcagcctggaatatagcaagtctaaatgacagtgggtatcaatgaaacccggttgctctggctgccagatggtccttggcggaaagctagatgcacgtcctccataaggatgtcctaatgtctcctcttgatatactctctcctccttcgcctctgcttccacatttctggagtagtaaaataaggaagaattcttggatctgccttcctctgtcatcttcagatctctggatgtgttttcggagctcactggaaaactggtggaataatcactcaggaagctctggtggctgctcctctcaccctggaatatgttgttgttgcttctgctgctgctgctacagctgctcttcccagcctgcaatgtgttactgctgctgcccaaggagggatagcaagaagacttggtactgctgaaccaagagctggtgtagtcatgccaaggactataatgaggtggaaaagtggtgtagtcagtggcgtagtatggaggctctgacactacaggaagacacagtgagaatggcttctcttcagagaatatgactgtggttccacctacatcagaccagtcactccctgaagaggggcgctcaattgccatcttttctttgtgcttttgaattactgaatgggagttatagttatccggaacatttaaaggtggagagcttttttcacaaatgactctactttggttgctaagtcgcttttggattattacatgggggttatagtcatccagaaaatttgaaggctgagagcatttttcacaaatgagtgtattttgtgttttaggtcgcccctcactgaatttctcaggaggattaacagtcaccctcttgtcacaggagctgctcatttctggggctgactctttctctttttgaggagcaaagatagtggcattcctggctggtctttctccacagtagggacactctcctaggtctgattgtgaactaatgacagcctcttcctttacttttggaatgtcatctcccaggatctcctggagaacactcagagacaatgaagagccactatcttgaggtctacccttcctgctctggaacttgtttggttcctcagtttcattttgaccctcacttccagctgtaaattgagggttcatggaattataggagctacgtttggaattaattttaaggctgtagataccctcctccagagaagccatttctttaaaaacggggctggcagagtgcactggggatcacaaggacgaaaggaactccaaatgctccaaatgaggcagtctttggagccggccctaatcaggccagtggctgaggaatgggaggagaaggaggagaaagaatttctgtggcaggatgaaccttgagaaaaacacggtgtgcaggccacaaagtagcctttaggcctttcaggcctttggggcctctctccccttccaaaccacgttactgagctccgcggggcacctgtgtttgctgcaaaccacgttactgagctctgcggggcacctgtgtttgctgggggatcctacctaagtgccgctccggtggtacttttctgcgtgccgacgggccccagagctggagggccctcacgccactccggcgcctccttttttcaactgtctatcacagttctcggtgttctagagatgccaaagcccttccacaattatttcaaagtgctctggagaagtcctaaggatccaggcctggtatggcgtccgagcccggaacgtactcctaagactgtcccaaatggtctgattttgcgctgtgcaacttcccggatgtaaaaaaaaaaaaaaaaaaaaggtacttccgtggagtcaaagtgtttccggggagtcaaagtggcctggtatggcgtccgagcccggaacgcactcctaagactgtcccaaatggtctgattttgcgctgtgcaacttcccggatgtaaaaaaaaaaaaaaaaaggtacttccgtggagtcaaagtgcttccggggagtcaaagtgcttccgatcggccgtgcgccgtggcttacgcctgtaatcccagcactttgggaggccgaggtgggcggatcacgaggtcaggagatagagaccatcctggctaacacggtgaaaccccgtctctactaaaaatacaaaaaattagctgggtgtggtggcgggcacctgtagtcccagctactcgggaggctgagccaggagaatggcgtgaacctgggaggcagagcttgcagtgagctgagatcgtaccactgcactccagcctgggggacagagccagactctgtctcaaaaacaaacaaagtgcttccgatcaaaactcttacttttggtttggaatacaaggccctttggagatgtcagagtccatgaaatgactacaagacaccttagggatcagacacagggtgcccctgggtgggcttctggcctagatgccctgatccccaacggccagctggaggacagggcagaacatactgtagaagccgagtcgggaagcctgcccagcccccatcacctcgcctgccagcctgggtcaggccagcagcccgctccatctaagagcaacactcacctccccacggccatccagcccctcctttaccacgcctcttctcactgcccagccacgtgtctacccgagctgcagccattacatgctttttgttcctcccctccaccctcagtttcttccaaaagcgtagtcatggtttttagagcatagtttaaaaacatagttttaaaaaacatagttatgactgtggtatataacaattttcagtcttgtggtgttttttttttgtttttgtttttttctttgtcctcctctcccacccccccacccccccccaccccccccccccccccgccccgagagggagtctcactctgtcgcccaggctggattgcagtagtgcgatctcggctcgttgcaacctccacctcctgggttcaagtgattctcctgcctgtgcctcccaagtagctgggactacaggctcgtgccaccatgccaggctaaattttgtatttttttttttttttttagtagagacggggtttcaccatgttggccaggctggtctccaactcctaatctcaggtgttccacctgcctcggcctcccaaagtgctgggattacaggtgtgagccaccgtgcccggcccagtcctgtgttttagtcacttaacattactgtatagcctcagtatttttcttattgcctcatgtttttcaaaaatatcatgctggtgcctttataatactccatggagaacgtagatgtgccgtaattcaccaagcccttccctttttgttaacttttcaggtccccttattctacctttttttttctatgataaaaagctgcaaagaacatctttgcacatacaagtttcttctgtattttgggttgtttctttggactacgtgcggggaaatggagttcctgagaggaggtaggaattttaaattggttcctcataacattacattgccgcagaaaattgtactaacttaaaatctcatccgtaatgagtggtccatttaataggagaaacacacacataaaccctatgcctcgttgttattttaatttgcacttaatctgacagtttcttagagtgaacttctttttatttgttgaccctctcatgaattttgtttatgctgttttcccatttctcttttagggtctttaaaaaattaaacatttttataaaattaaagtttagccatattttctaaaatgttttgttagcatgtttttgtttatattttagtatatcggagttataacttatgtagttaaatcttaatttttaaaaatgttttctttctctttttctcccaagcctgcaatgtcattcctccttctgaggcttgacacatatttatttttttggaaggtgaaaggaattgatttattatatttaagccaatacttcatctgatatttgggttggattttacaggaaggaggctatacactgatgcttttccaagttggtactttttttgcttattgatatgtgactcctctttcattatgtgttaaattcctgttaacagagtctatttccagggcatctgttcttttacacctactatgtctcttgttactgtggtattgtactactttaataaatgaactattatattaaggtataaagtctgggagagctagatttccttcattacacttaaattttacaactatctttaataggctgaactatttatcaggtagacttaaaaaaataattctaggccaggcccggtggctcacgcctgtaatcccagcactttgggaggctgaggcgggtggatcacctgaggtcaggagtttgagaccagcctggccaacatggtgaaactctgtctctactaaaaatacaaaaattagccaggcgtggaggtgtgcccctgtagtcccagctactcgggaggctgaggcaggagaatcacttgaacccgggaggcagaggttgcagtgagtccagatcacaccactgcactccagcctgggtgacagagtgagacttcatctaaaaaaaaaataataattctaagtccctccagaatgacattgaaatacccacttgaaaagttattttagtctgcttatccagaatatacttcgcctatccttttagtcaagctcttctattaatatatcttctagtaaatatttttagagttttatctgggtcacagagtttttattaaaactatttttaagtattttgtaattttgtattatgaacatactttccccccattgtatggtctagctggttattgctaacacataagaatattttaaattcaggtatggttgtactgaaatctttgttagtttttcagcctttgcctaggtcattattttatctacccataatgataatttttgtctctttcttgctaatatttttacttcatatctttctacgttgtccagagcttttaaaaacaatattaaataatgatgctagtaggggcattattgttctattcctgattttggtaggcacatagtttaattaagtattatgttagatatttaggctgttgttttaaagcagatctttttgtaatcttgttaaggaactacccttgcatttaaaaatgtatgtggtaggaaatggtgtgagatcattatatatttgctcatatttcctaattgggaaacatgttggcatctgtgagtaaaatgctgttttttttttgtgtaggtggcttgtaactgttacagactattaaattctgtttgcttgtattttacttaggatcttctgtaaatcataagtagtgaaattgttctgtagcagtagttctcaaccttggcttgcagtttgtaatcacttggggagctttaaaaattactgatgcctaggcccaccctgagagaatctgatttctgtgtgtgtgtgtgtgtgtgtgtgtgtgtgtgtgtgtatgggggatggtggatgtctgtggcgggggttggggggctggtggtggacagtgtggccaatgcatcaggatttttaaaagctctataggtgattctaatgtgtagccagggtgagaactattgttttacagttacttttttttcatggtacgtctattaggcataggaattcacctttgtagctttccatcatttttggtatcctggagagttatataatttggtaattttcttttccttgaaagttggaacaaattcattagtaaatcatcctggttggagactttattggggcaattctttggtaatttttttcactgcttacttggttattagcttattcattgtgtttttgataagtcacggttcttacagaatatcacttatttaattgcaattttaaaattcattttcatatgtttgcatgattattataagataatttatcttatggtttatatcttataattgcatctctgtcatgcactgtatcatttctcattttatttatatttttcttgatgagctttctaaaatcttatctattttatttatttaaaaagtccttggatttatttattgcagttgtttttcttctttcaaatttatatatccttactatcttttttgctttctgtttttcttatgacaaatttttgctttttcaaaaccttttgtttattgttttgaggcagtctcattctttcgcccaggctggagtgcagtggcacgatcatggctcactgcaacctctgcctcctgtgttcaagcaattctcctgcctcagcctcctgagtagctgggattacaggcatgcaccaccaggcccagctaatttttttgtatttttagtagagacggggtttcaccatgttggccaggctggacttgaactcctgacctcaggtgatctgcccgccttggccttccaaagtgctgggattacaggcgtgagctactgcgcccggccttaaaagcttttgtttgaatcattgctcactggttctaaactctggctatgtttcagaattacctggggagagtaggaaagaaaaagaaggatcttgtacttgcctatctcaaagttcatggctgagacctctataacaaaagacagattaacaagagaaaagcacacaaatttatttaatgaaagcttcaggagacatggagccttcagaaatgatccaaagaaacaggaaaaactatttttatggacagtcatgtagaactgtgactggaggacaaaaggatatgatctaatggtaataaactggggggaacttataatagcaagatttgtttgttccgatttttattcttcatccttatgtgacactcctttcctctgggtatagggcaggacacctgtcacatgcgagtctatagggaaggaggaagggagaaggtcagagaatgaccttcctaggtgttatgacctgcctccggggagaatgatggaagaaggtcagagagaccttcctgcttctgcctttttctcaaatgccaaggtgccatgtgcctcggcatatttgccgaggtagcatgtcctgaaccccatcagtagcttttaaaaaatagtaatagtcccctccccaaggttctgatttaacttacttaggcaagggtctgggttttttgtttgtttgtttttcacggaatgtcactctgtcgttgctcaggctggagtgcagtggcgtaatcttggctcactgcaacctccacctcccaggctcaagtgattctcctgcctcagcctcctgagtagctgggattacaggtgtccaccaccgtgcctggctattttttgtgtttttagtagagattgggttttgccatgttggccaggctggtctccaactcctgacctcaggttatccactcaccttggcctcccaaagtgttgggattacaggtgtgagccattgcgcccggccagatctggtctttcaaattttttttaaagttcccaatgcatagccaaggctgagaaacactgttagcaatttatcctctctctcagactctaaattcttttatgtaataattttaatccattaatttaccccagattgcaaatttgcctatatcctataggtttgtatggccttatattttattatatacttttatataaatttattacatacatgtatataaattttatttgtatattttttatatttttagatttatttttggtacaattatgaggagtgacaattttcgtttataggtacattatacacttctagttgtattactttgtgatcagtgaatataacttgtataatttttctgtttttaaaatttattaaaatttttgtgaattagcatatgtttcagatatatttctgtaaatatatatattgtcatgtataaaggagccatcctctatatgcaacacaaaatgtattatcgtttatttccttgattatgggacttcataatcatgagagaaaccattgatttaataacagctttttcaggaagaataaacaacactgtattaaatgtacacaaatttttcttgtctactaacatatagagcatgcatttatccttaccattatatcccttttatagtacttcacaatttaagtctgaacctttttcataaaacagagcttaaacatattaaacttggacatgtgatgttgacctctttataaaatgttgaggttattgaacattgccgatgttttgtctttctttcctgacagcttctctagaaattcagctgtaagatttttttttttttttttttttttgagctggagtctcgctctgtcgcccaggctggagtgcagtggcgcaatctctgctcactgcaagctctgcctcccaggttcatgccattctcctgcctcaccctcccgagtagctgggactacgggcacccgcccccacacctggctaattttttgtatttttagtagagacagcgtttcaccgtgttagccaggatggtctcgatctcctgacctcgtgatccgcccgcctcggcctccgaaatgctgggattataggcgtgagtcaccgtgcccggcctcagctgtaagtttttgacattagatgtttgattcctgaagtgatagtctttctgactcacgtattggccacatcagcctccccatctttaaaaattatatgctttattctaagaaattaggcttttgcctttgccttacagttgcatggtctagcctgcaatggacaaccttctccacgcaattattttttgtgtcatactgcatcagacaataatcattttcaaacattttaagtgaaaattaagaatctaatgttaaaatccagctgtttgggatatgcaatgctaagcaaataactcaactgtcatgaagataggatagattcttctctacaaagctaaatttgcaccatatatcaagttagaactacttcccatcaaaatgcattcttgactgctttgagattcttttggctttaattgtaagaagatcctgaattcagaaacattaacatttaaaatttttcctttgtaatgaggaaatcatatacctgttatttaaagctaattgatttcagatttcaggagttttttctttttcttttttattttcttttctgtttttctgtcacccaagctggaatgcagtggcatgatcatagcccagtgcagccttaaattcctgggctaaagcaatcctcctgcctcagcttcctgagcagcttggactatgaggcacgcaccaccatacctgactagttaaataaagaaaaattgttggagagacagggacccatgtgtcacccaggctggtctagaactcttggcctaaagtgtttcaatcctcctgatgtagcctcctaacgtgttgggattacaggcatgatccactgtgcctggtctaaggttttatatcctctaggctaagattaaaattccaaatgccttgaggatcaggtaggtaacctcatataatatcatagggcctgcagagccagagaggcctgtggaggactgaagatcacatgcccccaccaaatgatatttatattccgttttcaagaaaattgcagccaattacatcctctaggaccttatttttcttttttcttttttttttttttgagatggcgtctcactctatcacccaggctggagtgcagtggcaccatctcggctcactgcaacctccacctcccgggttcaagcgattctcctgcctcagcctcttgagtagctgggattacaagcatgtgccagcacgcacggctaatttttgtatttttagtagagacggggtttctccatattggtcaggctggtctcgaacccctgacctcaagtgatccacctgcgtcggcttcccaaagtgctgggattacaggtgtgagccatcatgcccggcctaggaccttatttatctagtttctgcttgacatcataaatgatgataacaccttacatcataattatgttcctataaattttcatttttaacagtttttattttaggttctgttttctggattctctgatacatcaagttccattgcaattagatcatttatttttgtgagatcactttttaatctatttggtgtctctcctcttacattctacttcaccacattttataatttcctcttcctcttccttttttatctttccatctctacctcattctgacttgctctgtatctttcatgctggagtttgacagccctgtattctcatgggagcagactatgaaatatcagtctgtccctcatctagacatattgaagcccaacctaagataatgtctttccttttctctttatttcaatttagcatccttctcttttaatgcatcatttgattgataaatatttaatgattacatacatgacagttgacctatgccagttgtcaattgacctatgccagtgtagtcattctcaaatttatactggcagcattcagtatatagaggtgggtgacagccaagaatattctctctacactttcctacttgattacaaagaaaaaaaaatctcagattaaatattacgtacactgaaagtttgatgaagccccagctctttctccttttaggtgttccaacatctttttttcctcctccttttttaaaaaaaattatttttgagacacagagtctcgttctctcacccaggctggagtgcagtggcgaggtcataactcactgcagcctcgatctcctgggctcaagcaatcctcccacctcagcctccctagtagctgagactacaagtacacgtaaccaagcccgactaatttttaaatttttttttgtaaaaacggggtctcattatgttgcccaggctggtctcaaactcctgggctcaagtgatcttcctgccacaggcctgagccactgtagccagctccctccccctactttttaaaagttgaaatataattcacataacaaaaactcaccattttaaagtgtccaacacaactcagtgtctaatatctttttttaactgaggtaaaattcacataacatgaaattaaccattagccattttaaagtgtgcaattcagtgacatttaacatatccacaaggctgtgcaaccatcacatctatctagttccaagacttttttgtcaccccagaaggaaactctatacttgtccaacagcatcttatctgaaatattcactcaatacaaatgtgacagcattctagcaatggggtttagctaacctaattggagtcaggccagacaaattctttaagaaagcagctgaacataggactatttgggaatgaagccaaaggtgccatcctgaagggagtagatctctgggttcaccagactcttataacctgttcctgtaaggacagtgcctggttagtatttgtaactgatatgtgcattttgaatacaatcatttcactaaaatttattctaatatcatttatggcaattgacaaagcttcttgtgttgatcaaagaaaaagctactgaggcattctgttagccacttctgaagtgtgggcttctgataaaaatatgctaaacactcctggagtatatattcttacttaggttaactgaccaccacccctagagggtagattgcatctaacagactcactcatatatatcatattgtccacattgaataaccctggagttacatcatatgcacagttaagttttgcaacttcaattataaaaattgatcaaaagtgagagacaaagagaatatttaaatggagctctcacagagcttgagccgcaggtcaagcttgaaatggtagcctgaatctacttttcccacagttgtcctcaattaccttgtcgtgctcagtgtgtgagcaggatgccatattaagaatgtttccaatggctaaagatatatattattcatacaacatggcacctaagcataaagaaatgattttaactggtcttcaactgaagaagcaggcagtcatctgcttcaatatgggagaaaaatgggctgtgttttacttactgagaggcacagttttctaaagtagttaaggaattttcaaagatatttttgactatctctgaattttaccataactgctttagaatccacctgtccttcccttccttattccctaccgcccccatacaagatgagtctgagtctagcattgggctaggctccttgaggttcccgaagtgtaaggtggggtctccagggcattggatgaatttcagatatgcctgcttgaattgcctgaaggcaagcaatcatcaggactaacagtcaggataattttatgccagaaccaaggcagctttgtgttattgttaatgggaaaaaaatgacaaaacttattcatcttgtgagaaagaatattttgtctctataacatatacatttagaatcccactgtgaaatcccaaaggcagactctagttcagtttatggtagagctgaacgatggatgtattacttgaatatcatttccttgttttaaccagatggtgataaaagtattaaataatctttatgtattgtatcttagattgtatatccattcgcatggctgatgtgtagaatgagttcttggaaaaattctctctacttttttctttatattaacaaaaagtatacaggcagctgctttgttaattttaagtttgctgaattttcttttcatttcttagtttctaattattattccaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaaggtatctatttaaagcagagttatggttccttcacttctgactcctgcctttatatactgcctgcctttagcttttcaaaagactgcatgctactgtttaggctgtctaacctgctggcagtggtgaatataaacatgccattagcgtgtagttattgattgtgacttaccagctttctaccctctgcatgtcaacattggctgggtctctcactcctccgtggcatacttgtatcctttcaggtgctgctctggtatgagtaaactctcctgtgcctttgactttttcctcaaaccctttggtcgccttgccgtgagcagatcacttccttcacaacaccattaggggagaagagaaagctgttctctactgcagcttccagattggcattctcttctttcttgaatttactgtcatttgtttcaaccaccccctcctcatcctcatacctgttaactacagacttcgatggtacctcaccagagagtcattgttccttcaccctgtgtatgccagtcatctttgtccatactcctctcagccacagataagagttaactctgtgatgtggccaccagagaagctaatcctaggttgcattaagtatggcagagatcaatggagatgactgatttcttctgtttgtgctgtgggtccttctcttgggatgctgcggagttctgaatgacttcaggggacagcaactatgacggtgaaagaactgaacatttgtcatgtgcaagacagaatagtgaaaagggatatttgtctgtaatggggagactccagtgtgcttgataaatgtcctcaggaatctaaagggctgtcatgtggagaaggggtgaccttattctctttatgttcatggatgggacctaggggtcagagttcaggtcagtaagaggaagaactttctggcagagagctgctagaagttatagggaatggacctgggtagggttggggttaggggtctggtgtaggggcggaggagaggagagtcacagatttgtttgttccctcgtgtagatagatggccctgggggcaggtcaggggtggtttttcactgacagcctgctggaagtatgagaggatttgagtgtttgtttggttgctggtgtaaatgacctttcagggtactcagttccttgacgagctgattcttgggtgtgttgttgtttctttgccttttagagtattgccacctccagtatctcagtctctgaaattgtcttctctaactacaatatatactccttttactttccctacttgctcataactaccatccctgttcttcactctcctagaaaaacatatcctgaatatgtccatgtctttccatccccttcactaccatcctcacctaagctaccctcatctgttgactagaggaatagaatagctgcctaacgtggtctccctgtttccattcttgctcctcctacaatctgttctgtatgcagcagggagagtgttgtgtgggatgttacctggatacagtggtggcctttgagaattgtacatgcaggctctcccagaggtcacaaaacagaaggctcatggatcacattaaaatgcatgaatcacatgttacattaaagtaatttaaaacacatgatgagaagaaagagggaaagagatagggtaggttcacacacttgggacagggtacaagtaggcagaaggaccatactgcctgaatcctggggtcagcaatggttctgtctctgtttcactaaccttccctgctactagtatggtttagagaccagaactgaggttcaagcaaggagaaccacagacagaaggggcttcgggctgagggcacacacttgctctgttggggagatgcagggagaagtgtgcctggccatggctgtagcttgtcaataagcctgctggatagtcttgggttttgtttgtgtttcttgggcagaggtcacatggggctagaatgggtgtcaccgatgaatgagtggccaaattgaggcctcataaatattgggtgctcatgaatatttagtgtccttatatatttagcatatcatgaatatttagagtccaggtgcctcatgtatatttacgacctactgaaaatcagttatcttttggtttttccatccctttctttctatgtttaacatgcccatgctctacttagcatacctacctacctattgttatttaacacatctcatgatttctgcctatgctgaacaaattttgcttactaattactaatctaggcctgagggctctgtattgatataccacaatgagttcaagggggagaagcagggatttgagggccatgggctctgagaataaggttgtcatgcaacctcattaagtgtgcagaggacttccttcaatgctcatgagattgaggtttttcttagagcatggcttcattgtgtctggtggttggaataatgaatttggagccagccagcattgccaagaagtatttgttggatgcctattctgtgtcaggcactgtgctatgttttgggaaaatggacaaaaggactgagtcccatcatagccctatctcatggagtaataataggccaccagattggaaaggaaagggagcaaggccaccagtccaagagttttgcaattgttcaggctagaaatgctgagtgtccaaaccaggacaatgatggtaggaatagaaaattggggaaggatttgagagacatttggttggcagagttgatatgcattggccagtgattaaatacagagagtgaggagggggaatatctaatgaaaaagtgcctaccttatcattatctcatttaatctcctgatgaccatctaaagtagttactgtcactgtcagcttttacagaaaaggaaacaggcttagggaggtaatttgctcagtctgttttgcattgctctaaaggaatacctggggctgggtaatttataaagaaaagaggattatgtggctcacagttctgcagactgtacaagaagcatggcaccagcttctgcatctggtgaggcctcaggaagcttttactcgtggtggaaggtgaaaggagagcaggcgtgtcacatggcaagacggggagcaagagagaaaggaggggatgccagactcttgttaacaatcagattttacggtaaccaacagaaagaactcacacattactgcgaagacaacacaaagacattcatgtgggatccacccccatgacccaaacacctcccagcaggccccatctccaacactggggatcacatttcagcatgagatttggaggggacaaatatccaaactatatcggcctcagaggtctctgtggttgagtcatgatacctttataaagcccaggagcacagagcaagaaacaggattggggtttgaatctggggtgtgtttcagggcatgaggcctttgaaggggtgttagacatctgtgtggtgatgcccctccaggcaggtacaaacttaggatgtgttttcaggaaaaaagtcaagactagaaatggagattgggaatcagaggtgcccagatcatgaccaggctattctaccatgttagaggagagccactggtgaggtgatggaaagataaagggaattcaatttagtgtctctgcttggttttactagtggtgggaaaagacgaagattagtatgaggaggtaatatgaactgtcctcattgttctttgtgttccaactgatacactatccactccctggccattttatttggtgaatttggcctaatggtaaatctttcaggaaatatggaaataccataacattttaaaaacaggttttcacaaattttaaggttaaaagtatgacattttattttacaaagggacaagaggttttagattctttagggtcatttaaaacatataaggcagtttttaaagattggcaagaatgcattagaaaatggttgaagattatttaagaacaaagaatttacaatttataatttttgtggacatctattttacttacgtgtatttgattatataatagtattgctgtggcaaaaagaaaaaatttcttacaggttttcacctaaacattttgttctgatattccctcactaagctctgcttattttctgattactttcccaccatgacaccaaacttgcacaaatgatagactggaggtcacaggacaccccaggcctgggttagtgacttgcattattgttttcattattacctttaaagtgaaagctcataatcctatagctcactggcccctgtccagttcatcttagttttattaaactatccaagaagaaatatgaaatgtagcttcttttagaatcttggaaaggcttttattaagacttctcaattctttcagactcttgatttcaaatctcacataggcagattccaaaggcaagctgaagatagtcataatgatgtacttgaaaatcattcttgtgtaaggagggaggaatgctatcataaagtctcagaaaaaaaagacctgagtaaaagacaactttaaagtctctggaaattttccgaatttttgattggctcactgtggtcaggacatttccctgtgtgaagacacagctcaagagttgtgtatagaatacacagtaatcacgctgcgtaatgacattgaatttgtcagcagagtagagaaatttggaaggctgtagcaaatcctgtagaaagcaaacatgaataaccactctgtcaccaagctttgtttagagagaaaccagtctcttgaaatatttaatatgataattcttgttaaggaaggtctatttggactgcagatagtttgaaaaatcatttaaatgccttcttcaagcttttctaaattaagtgattggaaaaaagaaaacacttaatgagccagtggttcagacgtcagtgggacagggtaggtagtgtttctttcagttgtgacttgagtggcccgggcttgctttccatgcatctgggccctgggaagaggcaaatggtcaagattaggtgctgtgcagtgatggcgttcctgtcacttccataggattttgatattttctagatgaacttggaggtcagatgcacttgtttcttgtgtgaccatttggaaattagtgcaactggaggaattataaccctcccctgctcccttttggttgcctctattatcatgtaattttttagggtggggggagtttggaatcagccagaaacaaaagaggcatccattagcatggtaccaaaataggcattcatgcagcttctaatcagaacaacatatttttaatattcacaagttcttgttggcaaggagatttgtgtgtgttatgagtcaagaaagccagtattgcacttcaaggcttgctttcatttcttgccaggacatcactctcttttcggttagatgtgttatatttacagaacgtgttgcttttctgctggaatgtagttaaaacaacattatatcaagccaagaatgtcagaggttaatccagtagttttacctctaattgtctaacagaataattgtcagttaaatacaccaagtccagcctaatctgtgctaaagaaaggataatgattagaaatgtgccgtgattttctggtatggtctataccagttgttctcagttgaaagtgatcctcagaatctcctagcccaccccagaattttttcttctgtagacatggggtcaagaactggcttccctatgattcttagtgcatcttggttgagaacactgatttccactaatgacttgttttggccccttaataaggtagtatttctcatatatatattttttaatactctaagataatctgcttgatcaggcaaatgtaatcacacaaaatagaagtcagtcattcatatgccattcactcttattgggcatgtactatatataggtattatatcccataaagtggtggaggggtggtgggaaggttgccagatgaagtataagatactcagttatatttgaatttcaggtaagcaatgaagtttttagtataattatgtcccaaatattgcataggacatagttatactaaagaatttggctgggcatggtggcttacacctgtaatcccagcactttgggaggcagaggcgggctgataacttgaggccgggagtttgagaccagcctgaccaacatagcaaaacctcgtcgactaaaaatataaaaattagctgggtgtggtggcacatgcctataatcctagctactcaggaggctaagacaggagaattgcttgaacctgggagacggaggttgcagtgagccgagatcacaccactgcactccagcctgggtgaaaaaaaattaaaaaaatttaaaaaaaaaaagaattctttgttgtttatctggaattcaaatttaactgagcagcctatattttaatttgctaaatctggtcaccctagagggtggacactggggagagaaccaggtacttgagggattagaggaggaaaagccaatatccactagagaatctggcatttgaatggtacctcaaaagtttctctagataaagatggaagagaaaggcagaatagtcaaaaggagcaacatgagataaagtggtgggacaataaattgggaagtatttgggagcagatcatagattgaatagggaaaacagggcaagaaggtggtcatgcaagaggacattaaagcatctgttattttggtgctttttcaatagctaagggggagatgcgtagggttactgtttcttattgtgagcagaaatgtggaatttttaacttcttattcttttgctgcaaggtgagtgcccggttgtgtatataaaaataattattcttgtgaaaccgaaactctaaaggtgacattttagaaaaataaaagtaaaagtatacaagtcattttagtagaggaatatagtaagcacaagaggaagaaaagacactctgttatgtgtgattgtggttaagcctcttagtatttttagggcacaaacttgtagatgtgatgataagtggcaattgcagttatatcttcatttacctaagaaatatctgcctttagacttggatgtactctaggcctgcagcattactaaaatgaaattaacatacttaaattaaaatagaggtgacccaggtgcagtggctcacgcctgtaatcccagcactttgtgaggccgaggcaaaaggattgcttaagtccaggagttcaagaccagcctgggcaacaaagcaaggctgtctctacaaaaaataaaaagttagccaggcgtggtggccatgcccgtaatctcagctacacgggaggttgaggtagggaggatcgcttgagcctgggaggttgaggctgcattgatccatgatcatgccactgcactgtagcctgggcaatgatgtgagaccctgtctcaaaaataaataaataaataaaaaataaaatagaggtgagagtttggagtcttaattctggaaggtgaattccagaaaagtaaatttagtggtatgagcaaagatctaaggcaagtctcaactgaataacatgaaaacacatgaaacataaatggatatatggtcactttgatctaaaccacagggaaatgttagaaagttaaagcttgaagagcatagccagatagcagggcttttacaaaggaagagaaatgtaaaacatgaagatgaggaaaagctggacatgtgtcccaatagtctttattgggcagttaagataaactcctgaaaatttaaagggcaaatatggtgctttagttgtttttctgttttgtaacaatatctttatttatctaccttgatgatttcacctgctcttcaatgtgggtcaaggacatggtatcctgcccatttctttgatatcccaaaacaaattcctgctgatggagtttctgccatttatcgtggaagactaaaaacataaaaattctgataattagaaattttaattctcaaaggacacagttgagaaatcctatgaatatgttattgaaagctctcatgtgcaactgtacatttcaaatggcccaccttggttttctgattaatatggaattgtgacgttagatttttggttatcaaaactttactgttagtgttagacctgccttttctttctaactcatgggtgttcaggattcttttttgtcaccaagaagagcttccctggccttttctgagaagcatctagtgagagaagtgtagcggctaagagaaggaagagttggggggcttgagatctgcaggctcctgggagaggcaagtcagctggtggggcaggccctgcagggtgcattgccatagcagtgggtgggcatctctggaaatttccccttcgaggagagaggctgttctttcggaagagcagcttcatctctcttttcttttcatggtggctggtagctcttttatccatttccatcctgttatgcctatggctcttcctcctcaagtaatatgtagctgcagtacagtgagatacagctcagtgcaaactatggaaagtaatggtatttagttagagtctgaaagcccaacttcaagatcttttactgccatttgttagggcatgaccttgggcatggcatttaacctctctgagctttggttttctcatccttaaactgaatattcatatttcatgtattatctgccttatagaattattgaggattaaatgagaaaatgtaagtgaaagtttatcctagggctatgatgatgattgtgattagtattatttaaaagcccagtgggtgggccagtttttgccacctagaaaaatataggactcctattcaaagtcttatggaacaaaaatcatcgctaacttgcttatttgaatttctataatgaagtaaaaatgcaagatagatggaatttttgaagaagctcctgactgttgaataattcttatatattttaaaaactgtcacaatataagtatttttaaagtagtatataatggttcctgaaaatacctgaaatgcccatccttttatacatgtttaagtatgcaatttgttctaaatgtctaatcttgaatgattaaataatttgcatactgttttcagtgctatgaattaaaggctaattgaagtataattttttcacagtaaaattgtatcatcttttatgtagtacatttaaaaatattctaggccagttctaattttatagttttattattttaatttaatgcaccaagtaattaaaaattgctgcaaagaaaagaagctgaaaatgattttaggtaatttcccctcaacagagtgaaaagatgataagtagaataatggaagagagcccaacacagttcctggcacataaagatattcattaaatattccttaatgaataagcaatgactaatttctaagtgtctctagactttgagaaaaggcaccattttcagtgctgtataaaatacaaagaagataggttgacatctttatattaaaatacctccatgcagagttcccacaagccaatttttattgaatcattagatctgcagtttgttctgctttccttttctctttgttcttggagtagattctcaggcctaagtcagttacagatattgagagacaattctccatggtatcatgcatttctgtatctcttgtaagcagaggcactgacttctctttgttctggactatctcttcaaggatgtttatatagcaagtagctgtggaagacaaaaatagtctctccctctggagcaaagtataggtttgcttatagcgttggaagatagaggcttagtgtctccttccagtctaataaagatagtagctcccttggagataaagagcagggatgcttattgctaattatagaagatttgggttccctaagctaagggttactctcctgtaatgtaacccactgcatgtacaaatgttacctggcccttactatgtcatcctgtgggaattggggcttaggaaactggaaaaagaaatgctgatatttaggctattcttactgctgttgattaataaactgccttttgtctctgaccaaggcacctcctgtcttctaccagcatccatgaaactatggaaggctaacttctcatcttgcaagtaggataaaatctcaaacccttttttctttttttcaaattcttttttctttttcttttcttttctttttttttttttttttttttttgagacagggctttgctctgttgcccaagctagagtacagtggtgtgatcatggctcactttagccttgacctcctggactcaagcaattctcccacctttcagcctcccaagtagatgggaccacatgtgggcaccaccatacccagctaatttttttttaattaattttttttttcttttgtagagacaggattttgccatgttgcccaggctggtctcgaactcttgggctcaagcaatctgcctgcctcggcctccaaaagtggtgggattacaggcatgagccaccatgcctggcccctaaacaatccttaacaacagattgcagcaatatttgggtaacttggctggtatggtgtggtatagttggtacactcatgtaggcaaggaactcttttacctccagtggctgaccactcttttggatatacgtgggaccctgggaacatattctcaagaggagaaatgaatgggcatcagggttggaagtagaagatgggatgagatctagagcttttggcccagagcactggctagaactgtgaagcctctgataaccctcacttgaggtagtgcttgggtggaggtggacagaggctatagaggaaggaggaggaaaaataggttgatagaggaaagaagattccatgaaacttcacagcagccaaaagtgattcatccttattgaaacttctaagtcaatgttggcacctatcattccaaagcttactagctttttttttttttttttttttttgagccatgagtacacatttttgtgagcattctgcattggtgccttaatgcctgttgagtgtgctcacattgagtgcttgctggtggctgaatgtgagcaggcttgttctaggaaaagacatgatggcagcgtctggtatttttcgtcattctgcttatgtcccctgtccttcatcccccatcctcaccccagtctttatggtttattaaaatacttcccaagcaccacttaggcaactctaaccacatgcaaggctggccacagagctctgaacctcagaaatctcagctcattctgacttcctcagagttggaatgtactaatgctgcttcctagaacgagtcctttgcccagttttctgttgcgggaaagtattcagggttgttagtgaatgtgctgtatcttcttacttgttagccacatgataaaacagttgtattttctttcatgccatagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggtaaggaattgacgtttgttgagttcttgtcttcaaaataaaaatccctttggaaagtcagtaaagggtgtttgtactcctgatgcagatgtgaaagagcttttagagccatagttattccagttttgttcttctttgggctagagggaaggctgagtgttagccacagagcaagaatgacttcctcactgcctcaccccaattctctctgtagagactctctctttcaggcagtaggagtcttcagtgaactgcacaggtgagacagattctaggcacccacaattgactttgtggtcactgatggtatatgagttgtatccacatttccttggcttgtgtttttgctttttagttgtctaactctggctagaaagatctttgcttctatactagtgatttagtgaagcaagccttgggtacacattttttcttcctcctaggaaattccaggtcctcttaggatggcattggatgccaagatgctctggaagaataaggaagaccatgattctgatataccccctttaggaaaggatgtttatgtacaaggtctgaccccagctagtgtaagggagtaaagactcaatatttttagtattatttttgtcttcctattttttaaacagtccctgggcccaaattttgttttccagaagaatttgaacactcaaaggggggtggaaggtgacaacacccagctaatctccttgctgggactggatcgcaaatgtcttgactcttaccctgatttccatcattgtcacttgtttcctttttccttttctattgaagtgtgattacacacagtaaaatacacagaaattaagtgtacagttggatgagtcttaacaaatacacgtacccctataacctacccccatattgagatgtagagcatttctcttcccccagaaagtcccctcatgtgtttatcgaatcgatcccgctccccaccacagacaactgctgttctcatttctatacccatagatgagttttgtctgatttttattgttttaaaacttatgattcatttccttgcagagaggtaacaaaatttagaacaaaattctcttttgattctgttttgatctctttttaaaagccacttgtaggatcattcatctattcctgcctcccagccccagcagaattattctttaatgttgttgtaggcatacagccctctggagaaatatatatattgttgatcctggaatatctaaggtgaaatgcctgtatattgatgtacaaagggattttttttggtttggattcatttttattttttccaaatgccctggatgaaagagtctagataaatagaaagaatttagaaccagcagagagaacttgaaggaaatggatccaaatgaattgccaccctttgcatatggctgcagtcattcactaacagttgttgttatatgatagtgattgtgaataatgatggattatatgaaaatgcgcagagcactgtgggatttcataggtttatgaagaaaaaaatttatgtatatttaaaattatactttaagttctgggatacatgtgcagaatttgcaggtttgttacataggtatacacctgccatggtggttttctacacccatcaacccatcatctactttaggtatttctcctaatgctgtccctcccctatccccccaccccctgacaggccctggtgtgtgatgttcccctccctgtgtccatgtgttctcattgttcaactcccatttatgagtgagaacatgcagtgttttgttttctgttcctgtgttagtttgctgagaatgctggtttccaacttcatccatgtccctgcaaaggacatgaactcatcctttttaatgactgcatagtatcccatggtgtatatgtgccacattttctttatccagtctatcattgatgagcatttgcgttggttccaagtctttgctattgtgaatagtgctgcaataaacacgtgtgcatgtgtctttatagtaggatgatttataatcctttgggtatatacccagtaatgggattgctgggtcaaatggtatttctggttctagatccttaaggaattgccacactgtcttccacaatggttgaactaatttacactcccaccaacagtgtaaaagcattcctatttctccacatcctctccagcatctgttgtttcctgactttttaatgattgccattcttttttttttttttaaatggagtctcactctgttgaccaggctgtagtgcagtggcgcgatcttggctcactgcaaactctgcctcccaggttcaagaaattctgtgcctcagcctcctgagtagctgggattacagaggcctgccaccacacccggctaatttttttttaaatatttttagtacagacagggtttcaccatcttggccaggttggtattgaactcctgacctcgtgatccacctgcctcggcctcccagtgatcgccattctaactggcgtgagatggtatcttattgtggttttgatttgcatttctctaatgaccagtgatgatgaactttttttcatatgtttcttggctgcataaatgtcttgttttgagaagtgtctgttcatatcctttgtccactttttgattttttttttttttgtaaatttgtttaagttccttgtagattctggatattagccctttgtcagttggatagattgcaaaaattttcttccattctgtaggttgcctgttcactctaatgatagtttcttttgctgtgcagaagcttgttaatttaattagatcccatttgtcaattttggcttttgttgccattgcttttggtattttagtcatgaagtctttgcccatgcctatgtcctgaatggtattgcctaggttttctttagagtttttatgattttaggtcttatgtttaagtctttaatccatcttgaattaatttttgtataaggtgtaaggaaggggtccagtttcagttttctgcatatggctagccagttttcccaacaccatttattaaataaggaatcctttcctcattgcttgtttttgtcaggtttgtcaaagatcagttggttgtagatgtgtggtgttatttttgaggactctgttctgttccattggtctatatctctgttttggtaccagtaccatgctgttttggttactgtaaacttgtagtatagtttgaagtcaggtagtgtgatgcctccagctttattctttttgcttaggattgtcttggctatacgagctcttttttggttctatataaaatgtaaagtagtttttttctaattctgtgaagaaagtcagtggtagcttgatggagatggcattgaatctataaattaccttgggcagtatggccatttttatgatattgattcttctatctatgggcatggaatgtttttccatttgtttgtgtcctcccttatttccttgagcagtggtttgtagttcttgaagagatccttcacatcccttataagttgtattcctaggtattttattctctttgtagcaattgtgaatgggagttcactcatgatttggctgtctgtctattattggtgtacaggaatgcttgtgatttttgcacatcgattttgtaccctgagactttgctgaagttgcttatcagcttaaggagattttgggctgagatgatggggttttctaaatatacaatcatgtcatctgcaaacagagacaatttgacttcctctcttcctatttggataccctttatttctttctcttgccctggccagaacttccaatactatgttgaataggagtggtgagagagggcatccttgtcttgtgccagttttcaaagggaatgcttccagcttttgcccattcagtatgatattggctgtgggtttgtcataaatagctcttattattttgagatacgttccatcaatacctagtttatggagagtttttagcatgaaggggtgttgaattttattgaaggccttttctgcatctattgagataatcatgtggtttttgtcattggttctgtttatatgatgggttacatttattgatttgcatatgttgaaccagccttgcatcccagggaggaagctgacttgatcttggtggataagctttttcatgtgctgctggatttggtttgccagtattttattgaggattttcgcatcaatcttcatcagggatattggcctgaaatttcctttttgtgttgttgttgttgttgtgtctctgccaggttttggtatcaggatgatgctggcctcataaaatgagttagggaggagtgcctctttttctattgtttggaatagtttcagaaggaatggtaccagctcctctttgtacctctggtagaatttggctgtgaatccatctggtcctgggctgtttttggttggtaggctattaattactgcctcaatttcagaacttgttattggttggtctattcagggatttgacttcttcctgggttagtcttgggagggtgtatgtgtccaggaatttatctatttcttctagattttctgcatagaggtgtttataatattctctgatggtagtttgtatttctgtgggatcagtggtgatatcctgtttatcgttttttattgtgtccatttgattcttctcactttttttctttattagtctggctagcagtctatctattttgttgatcttttcaaaaaaccacctcctggattctttgattttttgaagggttttttgtgtctctatctccttcagttccactctgatcttagttattttttgccttctgctagcttttgaatttatttgctcttgcttctctagttcttttaattgtgatgttagtgtgttgattttagatctttctcactttctcctgtgggcatttagtgcttataagcactaaatatataaatttgcctctaaacactgctttagttgtgtcccagagattctggtatgttgtgtctttgttgtcatttgtttcaaagaacttatttatttctgccttaattttgttatttacccagtagtcattcaggagcaggttgttcagtttgcatgcaattgtgcggttttgagtgagtttcttaatcctgagttctaagttgattgctctgtggtctgagagactgtttgttatgatttccgttcttttgcatttgctgaggagtgttttacttcccattatgtggtcaactttagaataaatgtgatgtggtgctgagaagaatgtatactctgttgatttggggtggagagttctgtagatgtctattaggtccacttggtccagagctgagttcaagtcctgaatatccttgttaattttctgtctcgttgatctgtctaatattgacagtggggtgttaaagtctttcattattattgtgtgggagtctaaatctctctgtaggtctctaaggacttgctttatgaatctgggtgctcctgtattgggtgcatatatatttagtatagttggctcttcttgttgcattgatctctttaccattatgaaatgcccttctttgtcttttttgatctttgttggtttaaagtctgttttatcagagactaggatagaaacccctgcttttttttgctttccatttttttggtaaatattcctccctccctttattttgagcttatgtgtgtctttgcatgtgagatgggtctcctgaatacagcacactgatgtgtcttgaccctttatccaatttgccagtctgtgtcttttaattgggacatttagcctgtttacatttaaggttaatattgttatgtgtgaatttgatcctgtcattatgatgctagctgattattttgcccattaattgatgcagtttcttcatagcatcaatggtctttataatttggtatgtttttgcagcagctggtactgatttttcctttccacatttagtgcttccttcaggagctcttgtaaggcaggcctggtgatgacaaaatctttcagcatttgcttatctgtaaaggattttatttcccccttgcttgtgaagcttagtttggctggatatgaaattctgggttgaaaattcttttctttaaggatgttgaatattggcccccactctcttgtggcttgtagggtttctgcagagaggtctcctgttagtctgatgggcttccctttgtgggtaacccgacctttctctctggctgcccttgacactttttccttcatttcaaccttggtgaatctgacaattatgtgtcttggggttgctcttcttgagaagtatctttgtggtttcctctgtatttcctaaatttgaatgttggcctgtcttgctaggttggggaagttctcctggataatatgctgaagtgtgttttccaacttggttccattctccctatcactttcaggtacaccaatcaaacgtacgtttggtcttttcacatagtcccgtatttcttggaggctttgtttgttccttttcattctttcttctctaatcttgtcttcacgctttatttcattaagttgatcttccatctctgatatcctttcttctgcttaatcgattcagctattgatacttgtgtatgcttcacaaagctctcgtgctgtgtttttcagctccatcaggtcatttatgttcttctctaaactggttattctagttagcaattcctctaaccttttttcaaggttcttagcttccttgcattgggttaaaacatgctcctttagctcagaggagttagttattacccaccttctgaagcctacttctgtcaattcatcaaactcattctccgtccagttttgttctcttgctggcgaggagttgtgatccttcggaggagaagaggtgttctggttttttggaattttcagcctttttgtgctggtttttcttcatctttgtggatttatctacctttggtctttgatgttgttgaccttcggatggagttttcatttggacatcctttttgttgatgttgatgctattcctttctgtttgttagttttccttctaatagtcaggcttctctgctgcaggtctgctggagtttcctggaagtccaatccagaccttgtttgccttggtatcaccagtggaggctgcagaacagcaaagattgctacctgttccttcctctggaagcttcgtcccagaggggcaccctccagatgccagtcggaggtctcctttaagaggtgtcaacccctgctgggaggtgtctcctagcaggaggcacaggggtcagggacacacttgaggaggcaatctgtcctttagcagagctcgagcactgtgctgggaggtctgctgctctctttagagctggcaggaggaacgtttaagtctgctgaagctgtgcccacagccaccccttcccccatgttctgtgtcccaggaagatgggagttttatctataagcctgtgactggggctgctgcctttctttcatagatgccttacccagagaggaggaatctagagaggtagtctggctacaaaatcattgctgagctgtggtggactccgcccagttacaacttcctggcagctttgtttacactgtgaggggaaaaccgcctacacaagcctcagtaatgggggacgcccctccccccaccaagctccagcgtcccagatcgacttcagactgctgtgctggcagcgagaatttcaagccatcggtcttagcttgctggggggatccactgagctagaccacttggctccctggcttccacctcctttccaggggagtgagcagttctgtctcactggtgttccaggcgccactggggtatgaaaaaaaaaaaaaactgcagctagcttggtgtctgcccaaacagctgcccagttttgtgcttgaaacctagggccctggtggtgtaggcacttgagggaatctcctggtctgagggttgcaaagaccatgggaaaagcatagtatctgggccagagtacactgttcctcacagcacggtccctcacggcttcccttggctaggggagggagttccctgaccccttgtgcttcccgggtgaggcgatgccccaccctgcttcagctcgccctccgtgggctgcacctactgtctaagcagtcccaatgagatgagccggatacctcagttggaaatgcagaaatcaccctccttttgcattgatctcgctgggagctgcagaccagagctgttcctattcggccatcttgccagccacccccagaaaaagatcttttgtgccaggaattgagaataaataccaagaacagctaagaaatgttttaaataatttcctttcagagtaggaacatcattttagcatttattccctcagggagaaaattcttcaataaatatagtaatctttgggaaattaggagtttaataagaggcttctatattgactttcatacatttacttctgcagtgtttgctgtcttgaactgtaaagttaaaattaaacaatttaacttagactgaaaagaatcccatatattatcaataatgcttttcttagaggcctcataatgccaaagaaacatttttcaatcaattgaaatagtggtcccataatttcatttaaatatcagagataagactgaagagtctttggaaagccatcatgtctccccactgtcttgggttaagactgcacctagactgccctcgacagatagaaatttcaaaaatttacaaaaagattgtataacctgatttgggataacatctcccttgtcagtgtgcacttccttatataacagtcctatttggttacatcagatgaaatgggggcagtttaactccacgacagggctgcgaaagtgcaaatagagggaagagttgcatcaagaagactatggaactaactagtggttcctgggacagaggacagccgaggcagaggctctgcagaccttaagaccttctccatttgctgtgctcctgtttctccggggcattcttatccttgatacctaaagctttttgagctgaaataaaacagtgaatatatttcttcccttttaccttcacaaaaatctttgaatgagtaagaattatgaacacatatgaatttcccagtgaaaagacaaattatgtatttggttgagatataattaatacggagtcaaacatataaatcttaagtatataggtcaacaagttttgtaaaatgtgtgcaattgagtaaccaacacaaaaatcgagatgtagaatatttttaccacctcagaaagttcctttctccccatttctggtcaaattccctacccagaggcaattactgttctgatttctgtcaccgtagattagttttgtctgttcttaaataagaattttaaatctttttgaaaagtcagttttaaaaaatattaaagaagtatagttttttctttttttaatctttttttttttttttttttttttttttttttttttttttttttttttttacagagtattgctctgtcacccaggctggagtgcagtgacacaatctcggctcactgcaacctctgcctcccaggttcaagggatcctcctgcctcagcctcctgagtagctgggattactggcacctgccaccggacctggctaaacttttttgcatttttagtagagacagccaggctggtctcaaactcctggcctcaagtgatcgacccactgtggcctcccaaggtgctgagattacaggtgtgagccaccccgcctggccagaagtatagtttagtgtattaatgtttaatatgaaaaacttcctcaaacttgtttgtctctattctttttttttttttttttttttttttttgagatggagtctcactctgtcgcccgggctggagtgcagtggcgcgatctctgctcactgcaagctccacctactgggttcacaccattctcctgcctcagcctcccgagtagctgggactacaggtgcctgccaccacgcccggctaatttttttgtatttttagtagagacggggtttcaccgtgttagtcaggatggtctcgatctcctgacctcgtgatccacctgcctcagcctcccaaagtgctgggattacaggcgtgagccaccgcgcccggccagttcttaaggttaaaactggttatagatgtgtatgtatctatgtcatagttgaaattaaaaacaaaatcacagaataatctgtagaaaaatatatcttttttgttttcttttctttttttttttttttttcgaaatggagtctcactctgttgaccaggctgtagcgcagtggtgtgaacatggctcactgcagccttgacctcctggggtcaagcaattctcccatctcagcctcccaagtagctgggactacaggcgtgtgacaccacatctgcctaatttttttttttttttaagagttgtgtttttgccatgttgcccaggctggtcttgaactcctgaactcaagcagtcttcccgccttggcctcccaaaatgctgggattacaggcatcagccaccatgcctgaccaaaaatatatctttatatatttgtcacttgattgtgtatatcttagaagtgattatgcaaaccctgcaactattattgacattttctccatttgcaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaaggtgagcagtggatataaccactttgaatttgcttgtgggtcaagagactagtcactgtttggaatgttgtgtgttatgactatatgatgatagtaaccatgcactagtgcaggtatttagaaacctttcattttgtgccctctattaatacacatctgtgaaagtaatacagagaatatgatcaattagagttggaacattgaagttaaggcaagtaaaggaaaaaagtcaaatgtaagaaaaagcacctattcatcattgagttcacatccagttttatgaaactaaatgactccttagtaaaagaattgcttgtggctttggacagggcactgcagactactgaagagagcccatggtttggtctgggttgtgaatacaaacacacacttatacacgtgcacctacatgtgcatgtacacatgcactcacaaacatacacatgcaagtttacaaaccaaagtgccttttctgaatgtagcaactagtcaccaactagccactagctagtggcagtgatgacttttgcattttatttaacattaaaaagagttgtcagattgatttctacaaatatttatggccatttgagagctcatgtaatttgggtgcagcagaaacagcccagacctggattagagttgtgagtctgccccttaatagctgtgttaccttgggcaaatcacttaacctctttgagcttatttccccatctttaaaatgtcataacatagtaaaaaaaaaaaaccaaaaaaacaccatctaaggacctgtaaacacctataaggacacttaagaacataaaggctttttcaaaagctctatgttatattttctttcttatttggataaagtgtcttcttagtgcacatgaaaaggttaccataatgctaatttccgaggcaaataactgctggccattcagtcctcaccgggaggctttcccagattctctgagcccactgctggaagccctactgcgtttgcttggaggcaggagaggcacaatttgtcccagagggagccctgggatacccatagcaggcaaccaggaggtgtcagaaaaacctgtttttagaatgactttgaaaaataggctgaatataaaataataatgacatacctgacatttacagtgtgccaacattagttaattcattttattcattcattcaacaaatattcattgagtgccacctctatgccagccctggggttatagtaagaaagggaatggattaaatcctaccacatcttgttttgattttgtcttccagaattgcccacctagagtctatcaaccaggccagataacagatcgagcagttctcaattcatatggtgactttataaagaaccaagcggatggctacctgttcgatagatataagggaaggaacctcatattttattacctgtttctagtgtgacttctttggaacctgaacagtggggcgagttacgtactcttctcttgtgagattgtgaatgaaatcgatgaatacataaatgtatgcattgtactgctatttatcagtaataaacatgctgaaatgtctatataaatatatgcaatgcattgcagtttgtaagtataatactacagtgctaaaataatactttagaatattaacatcaactggttgcttttttatttgatttttaaaatttagttattaaagattgaagttttatttttaatttcctttttttctctgggaaggggttcctggttctttggagggtccatggtgccaatgctatgttcctttgtcttttttagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattggtaagtgatacatatgtcaattaaaaatatttttaaaattaaattgtttgttccctaattaagattttactttggagtttcaaatgctaggctcataatagctaccacttattgtgcatttgctatcttccagccgtttgttgtcttatatattcctaacaattctctatggataggctcattatccccattttagaggtgaaaaaaaccgaggcttaaagggggctcatttgtccaaggttatacagtgagcaaagagtgagccaagatttgaacttgtctgcctgatgctgggggggtaaatgttttggtttagcaatcgaaatggaaatctgaatgcttttcttttcacttacttcttcttaccacaatggatatacctaattgagttattgagggaattctcttctgctagtttgctctacctttcctggtgaggctcagccaggttttaagcttctctcttctcagatattaactccattccagtaaggttagttcagttcagaatgaaaatgagtgattgattaagcacctactatatgtaggtcactgtagtagacttaggagatagagttgtgtaagaggtttctaggctggaaggggaactgagacctgcagcgagtgacaccgtgttatgagtgtcttggaagctggcggaggatgtgacgtgaaacctaaagcataaaccctcatttgttaaactcccctctacctgaggctccaggtacctgctgctgctaggaattgatgggacttgctgacctcccagtttggtactggagttgggatagtgggtacttagtcctgtacttctttctgaaccttggagtattcatatgaacacacttccccgaggggcaagatggaagccaagtgcaaccgcagcttcttgaaagacaaggtgctttgtcactagaatgagatgaagccatgttatgtgtcttgttgtccgcattgtgtagtattcctggccttctgggaatctttatattgtgagagaaggcacatcaagtacacaagggggttagagtgaaaaaggcttacagttttactcttaggttcattaggggaatttgttgcactgcatctgcatgccagattagtcaaaatgtatgggccctactggggccaaattggtggcctctttttattttctaaaattagtccccttcagtggacacagttgggcatatttgccttggggactgtggacaagaagcagccaggaatgtgcaggtggcagctgctatagagaagctgctggtggcccctagactgtgggaaaagaatttggcctttaataaatgtagatgcctgtttggaatccgtctttagtgtagaatgaaaatttaaatgtatatatcaagatgagtcaccaaaaaccgtaacttacacctgatgattaccttaatataaaggatgtggtgttccaaagcattatatgattccttaaacataaagtctaacttttggttgatgtttgtctgtcagcttggtgagaatatgaaagttgcatttgggaaaatgaatgtcctactggtgggacttagtatgttgttagggtcttaacggcttctctagaaaattttttgaggcagtgtgaattccctggtgtgctccaaatcgagccatcctgggtaaatgtatcagcttcaaatgtcctatggtccatttcagtcgagtccttgtgctaatttctttctgttcacttcttttgttcactccgtggactaattgtattatgtaaaaaaaaagtagtctgtgcctctaaagctaatataacatgagcattatgcatttaaacagaaaattatgcaaatgcaaaattatgatgcatttcatagtcacactgactttttatatttctcataacatatgttaaaatatcccatttaacagacactattattacacaacatttcttgtgttacaacagtgtacttaatgtaagtaaagactagaaattatatctatgatgaggtggaggggagaatgaatcagtgttctctgataatctttgcatttgcttttcctgattttttggtaaggttaaattaatatccttaatgttgcttagatacagttatttctgccattttaattttatttatagttcatctggtctcagcaattttttaaattgaccaaattacatgcgttatgttttggtatccttaaaacccaaaccaggacaaagtcccatcaatcattgtggttctgtcaataattgtggtcacatttcctcctttgtcaataattgtgttcagtagaaaacctgggtatctccactgtgcagcacgcaggaaggatctgacaagcagcagcaacacagctaggggcgtctctagcaggaagtcacgggagatttctaacgcagtacgccgccttggtgctttagtaccttctcctgtgtaatgacaccccaacatattttgggggagaaaaaatggcagacaaagagaaggagttggccacagtcccaagaaaggtacatggataacctttctatttatgtagaagtggagggcttgctaaaattccaagagacatttgagctcctgtgtaaaactcaatctcttaagatgattccttcatacatttaaggattctaaggagaaggtgattccatagatttcttctctttaatagtgcagtgggaccccctccatcagacagtttggccatcctgctggccctggcttgcctgccaggctgtagcatgtcactccctcattattttatgtgaatgaacacggtccggcagatggaggtctgttgatctttcctatagcatgaaggttgaaaaaggctctaggggttccagcaggtgtttctttcactaaaaggacagggatcaaatgtaaactgttcttacgtaggaatttctgctttaggttattatttgtctatcagtggactttcttattttttcttagtggctgggacaatgaaactagtaacaagattgttcattcttgttgctgttgaacacttattgggctatgcttagattcaacaaaaatcttaaagcacctttaattttgtggagtcatttctggccatctctgaatttttaggaacagcaggacatttaagatgagtgtttaatgattatttgagtgaattggacacttaaaattgcaccaataggatagaattggcttctggtctcatcacatggccctgatggacctaacaattttgtttcttttgcttcccctatgaaatgaagatggttgagatgggaggattcttaaagattttatagctctaacataatgtgattcacgaatttaggtttcattgaaatcatttgacatgggtattgaatacaagcacaagtggatttaccttgaagctaatgaagcgtaatctttagaggtcttcctttccaggggtcccaatccaaggccctggcctaactttgtcttagtaatttgacattctttgcctagaagagctttgcccaaattatttaagcttccagcctcccaaaacctgtattcatctctaggctactagaacataagcagtgaacgttgaggtaactgaaggcttttcccagtagtctttcccactgagatggtgaatagaaaatcaccacgaagaagcattaagactcctttgtaatatgtatcatctgtctgccaatttgttggaatctagtcaaccatggatgggcattcaatatatatatgttttgacaagtcacttggaattagaggaatcagataattaaaagacatatctgtctcaggatctagcagaatgccaacttgagacattggggaagatgctttgtacaaaaatgtatactttttcatttattcaatgaatatttttgaacacctaaaacacgcaggatgctgggatgatggaaaaccaaagtgaggaaacttgtcattcagctgtgagtccagagctttgtgaacgtatgcaaattacccagataaatgggatttaaagttggatcttgagccagagtttccaaaaagatgtatgtggtggtataaaagtcaggcatgatggagtggaaaagttctcagcttttatacactagatggcactgtgggtgcagaggaaagctctaaattggttcttttgttacttaaatctgttgcaaaaattatatggttgagaaaacaacagtgtggtataagccctgtaattctagggggaagtgtagaatgcagtcctaattactttgagattcaatatgtgtcctcttttggttagactgcttagattggtatgtagagttgtatgtatatgtctcctgttgaaagaaactcctcaggcccagatttttaaataatcacatacagctctcctgccatggctatgatgttcttcctgaaatgaaagaccaaacagtggtgtgttagatgtaatggttagcaatgatagagtctactgcaattctgcccaattccaagatttgaactctcctctttatttccaagacttttctttaaaatcaccataaaaatagcaatagttgaagctcacaagtcacttctgtactggcacactggctcccccctttcactgagtcacctttataaacatgtctgctgtaagcagtctctgttaggatgtaacaatactcttttggggattgtttttggggaaatttcacacaaaggctgctaggaagtctaaggacatatgaaagctgaaaatgttttcaacaagagttagaagtggcctcaagcccttagccttttgatcatcagttaaaaaacaaaacaaaacaaaacaaaacaaaaaccaaacaaccaccttaatattaagagttaggttatcttggatgaaaaattgatctccattttctcttccggaggtgtgcactaaaatttgtactcttcctctatgggaactttgacagtggaaaaggaaatatttgcttatgtagaactcctttcatacaggattgaaaacacctatgtcatactgaagcttggggaagaagtagaaaatagattctgtgggagtttgttttgttttgttttaggaaagatgtggcatctttttttgccatttatgttggggacaaacacagtgacttggatagaccaggtcaatatgttccttgctctggagagcacggttgcttctgagattgtacagcctcgcaaatgagtacctgaaagctcctaggctattacaaatatgttaccagctctctctccacctctctttcctcacagatgataagtatataaataaaatcaacagtatttaccgcgtagcactcccttggagagagtaggcagttggctattttaaaagttttttctttttctgttttgtttgttcgcttcattgcatttgagtgcaattgtagtcttttcttgggcttaacaaaagctacctggggccgtggctggtgagaggaaagttctgttttggtgtttgtttttgaactacatagggaagtactatgacctggagttactttggaggcaatggagggtactcaaatacagggtgcagtaggaggagatggtggatggggaaggataaaggtgaatagtcaggagtaagtcctgtttggaaaagaattttattagtgagtgttgactgagataggagagggctaaattacaggttaaaatgtggaacgagtggcctaaagtttcaagtttgaattttcatattattggaaaaatcagaggagaacaaaaaatattcagaaatgggaatgtgatgacaaaatataaacgtttacttatttgacatagattcttttttttttttttaacttttgaaccaatggtgattattaagtgagttccatggtttttgtaaacatgattgaaaagtactctcacaggattttgctgttttgtttgaaagagtttaaaatagtctacaaagatctccatgttcatcttgaaaacataacaaacctttcaaaacagccataatcagggcaaaaaaaatattgatgttttgtttgcctttgttttgttctagagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacaggtgcttgagggaaccatgattttagtctgatctttcccaaatgtgtttggggtttataacatagttctcatgacgaaacagatgtcacgcagctcatctaattgcaagtccagggagacattattataggcttttaatgaggttgattaacatgcacgtattaacaggttcttacctgagtgcttattttaataagtatcatctggaggcccctaaagtaatattatctctagtctatgttgcctttccatatctatctatatatctgtctcccgaaaataggaaagatgtagagtaggagttaacaagctctttcttaaagggtcagataggaaatatttttggccttgtgggccatacggtgtctgtcacaaccactcagatctgcctttgtagcgtgaaagcaccacagacagaatgtaaatgattgtgtgactgtgttccaataagactttttttatggacactgacattcaagtttcatgtaatttttacatatcacaaaatattactcttattttgatcttgccaaccgtttcaaaatgtaaaaaccattcttatctcaaaagtcatataaaaacaggtggcctggtagatttggctcactgactgtggtttgccaacccctgctatagagatttcaaggatttatacgtgtttttaaaagtgttatttggtgattaatgttgttttcacttgagaggttggttgagttcagtaaccataggtttctcacttggctgaatataattttaaatgatggactttcagaagtattcctaatagacatggagaaaaacctgcctgtaaatcatgcatatagaatgtagacactgccctcggctactttttgcttctgcagggagagcaggccctggagaaagaagtcaggggaaaagtggtggggaaacattgtaggtgcttgaataggatgtgggctaagggttacagtcctgtgtgagggaaataatggataaggagattctggggagaagcagtgataaagggaatgtggtaagtctaggagaaggagaagaaaaagacatcctgaatttcataaaattgattggggtcaggtgctgttgtagcacatttgaaggagagagaacagtagttatgttgtatctataaaagtggtaaaaattgattaagaattatatagaatgtcttaaagtctgcctttgctatgacatgatgtcctttgtctttctagaaataatcttttacttttaaggattttagggttctatttttaagttttagatttgatgcttctcaggagtggtccctgtactttttagaaatgctaattattgtgtctcccccacccccagactgactgagatagaagctctggggaaggggcccaacattctgaattttctcaagtcttccagtggattctgagacacaccagtgtttgagaaccactgatttttatcacataagagggttgccagcttatactctgtcctcccttatcgagaacagtgtttaggtgaggttccagggtaggacttttgatggctaactgctgtttttaaggacagccacccgaaggaggcgggcaggaagaatgtccctattgtaaaaggagagggaatttttcttataagtaaacaagatgaaatattatccagggtgttgtttctggaacccaggggaaaaccgttctttgtgagtagttgacttagtccctctttctgtctacactgggtaaacttgcccacagaacactgactgtagatggtattccatgttcttttcatgttgtcctggctggagaatggtagtataggcacaaatgtctctcattttgttctttctgtccactgctcaatctgtgccaggaatacactttcctcaagctcttctcacacagggaccatgtttccatagtaactagcacattcggctggagacttatagatgagtttgaataacccaaggttttaaaactgtaagaacctaaggaagatgatttcacaaagcatacaaagaatagttttttaaaatacaaataaactgtgaattgagacatggaattgtacatgacacattgattatatatatattgctattaaaaatgtacttggtgctattattatgaggttaatgctgatctatgagtcattggagggaatagtttcagattaaagcatatgagcttttgatggatataaagatcttctttattatctgggtagatatcactgcggtagcctgctgggcagattgtctagtctgaggagggagaaccaggataatatctttcttgctgcaccaggctgaattagttactctgttctttgtgtgcccacagtactctgttgattatatttctaataataatattactactattactgattactcataataagccattagtggttactatgtgctatgttacaatacttaatctaatttaatcatcaaatccttggaaagtagataatgttattgtacccattttttacatgagaaaactgaggctcagagaggccatacaacttcctcaaggtgacacagctaatttttagctgaactaggaactgaacccagggaaatctgacttctggaatttacctgtctttcgacagaacctatacatataacagtgcatcttaatgacttgtttatgtaatttgtgggctccttttagaccaagagctccttgagggcaggggccagctttattgcttccataagagttagtgctggctatatatttggggatcaatagtttgtctaagaagagaaggaatggatgaagaagtgagcaaatagaataaatgttcactcatccagttcttaatcatggatagaagagacagatgacttctcaccaggagggttattataccagacttgtgccagtcataaccatatagcatccaaaaattcatggtttaatcttcatctctgtcttgttacagatattgtccatctgctgtccccaccagtcattttttttcttcttttaaaaatgtttccccattaataaaaataagccttcatgtgtgttccaaccataagactctatagctctagatatatttgaggtttttagtaggtgtatagccctggatgagccattcattatcttagtgaataactagttcttgaatccctgctgtgtgccaagcagtgttctgggtgtttgtgatacatcagtgaacaaaatagacaccaaggcctgccatcgtggaacttatattctagttctgggaggtggaccatcaattaatacataagtaaattatgaagtatttacaagatgttaagtactgtgaaaaaaataaagaaggtattaagttgctgtggaaagaataaaggcagattgggagtatggggctgaggaacattcctggttgcaattttaaatagtgtggtcttgatggactttactgaggagaggaaatgtgctccaggcaaaaggaacagtcggtgtaaaggccctgagcaagaagtgtgcttgggatgtgcaaggagcatccgggaggccgacatggatggagtagatgagtaaagagcagagcacacagagaggagatgagagtgtatgggggactgggtacacagggctctacagactgtttaaggatgcttttgactttgagtgataagggggccattagaaaatttgagcagagaagtgacttgagctgattttcttcttaaaagaatcattccagtgtagtgttgagggcagactatagatggcagtggtggaaattaagactgggtaagaagctactgcagtagtccaagagaaaagttttggtggctcagatctgggtgagcgcagtggaagtgatgaaattaattagtggatcctggaattattttgagggtagggccagtgggattccctgacaaactggatatgaagtatgaaagaagtgaggagttaagatgactctcaagatttgggcttgagcaactggaagggtggagttgccatctactgagatgagaaagactggagatagggtaggtttagggacaagagtagaagttcagttttagaaccagttaagtttgggatgtctattagatatcaagtggcaataccaagtaggcagttggatacatgtgtgagtatagggttcagaagataggtgaatgtggatgccatcagcatgtagatggtatttaaagccatgataccaaattgtattaaagccttgagattggatgaaatcaccaagggagtgaatatacctagagcagagcatgaccaaggaataaactctggaacatccccaattaggagcttggggaaaaaaggaggaaccaacaaaggagactaaaaaggagcaaacaaggaggtaggagcacaaccaagagaatgctggatcccggaagccagtgaagcaagagtaacactgaaggagtgatcatttgtgccaattgctgctgattggttaagttagataggcacaaaaaattaagcattggaattggcaccgtggagatcattgttgacctctacaagagcagtttaggtagagcaaacctaatggaaatggattcaagagaaaatgggagaagaatttgaggtaatgattttagataactctgggctgtatgtagaaaaagttaagacatggcttcttgacctaggaacttataatttgtttggggacaacgggaataaacacatttttaaaacaaccatccaagagtaaaagtctatatagagctaaattgggtgtggccttacaattgatgcaggaggtataagtaggtggtcagctggagcattgtgataaaaaagaatattctgggaagtttgaaaagtagttattagggaaatatctgaaaacatttgcagtgcttctcaaagtatgcccaggggaccaccttatcagaatcttctggggtgcttattaataatgcaggtttctggagatgtgagctaactactgaatccccccatatctctggggattggactctggattctatatatttaacaagctccccaggtgacttttatatataataaactttgtgaactgctattctaaaagttttattgagtagattatattctcaattgatgagatctccagaacactagatttaggtgaaaaaaaaaaggcatattgaacgtgtgaaaaacccacacttaacatgtacacttataaattataagaagttaaatttacagtaatattccttttcctgaagttagaccttcctcagttgtttcagtgatatttctagtatctgaaatgttatggctttcttgtgtgagaggggctaccaaatctatttgttacatataaatccaattatataccagagaagatggttgacaaggcatagcttccccccacactatatgaggtctgtctgaagcctggaaactgggtacagagaaaacagccatgcagacctggctgctttgctcaggctgttctggggtgagccttccaaactgctgcacaccgtctcacatggggcctcaagcctaggaatcttggtgctatcctttttcagcccggattcttgtacagcctgagaaaggagcagagaaaagcactttttgcctctgcaaatcagaaatacttggtttattttttaaatcactgtgaacacaaggaaagaatgattttcagtataggagaccctgcaagggaagacttctctgcttagagttgtgacagaggacatggtttattctcctgtgtacctccctggggtaatgattttagttatcaaagacctctccaagggtttactgtttcttacaaagtccacctttcactagcggatatccacagacatgcttctgctacagaccataaatcaatttcttcagtgaccaggcaatcagctttggtaacttttaattctataatttgatcctatctttagtctactagactattctatttatgcatagaattctgagtgcaaattccaatcaatacagatctcataacaattttccataaacatttattgaatacttacaatgtaaaaagtattatattagataatggttaataagacaatctttgtccttggaaaacagacttgtaatggcttacaatacgagtgataagcactatttaaaaaaaaaaaaaggtgggtctatcatatttgttatagcatttgaaaaggaaaagttaatttttcccttgaaggaagttggggggttgctggggagctggaggagtgagtctgagaggggaggatgtgggctggaagacagaaaagtaaagggcatgagacagtgagtggtgaatgggggaggtagccccagatactggcagagcccaggattgcccaggcagtagggctaggtgcttgctcttctttccagcatgattattgtgattggtgactagccttgtcattagagaacagcctgttagtgcagctggtttgaacagtgtgtttatgacgtttgttttgggttcattttcccaatgtgttacccaggacatgtaaagaatcagagatatcttaatatactgagaaaattcctctgcatttagatttagaaccttaattagacgatggttgaactctttcactttggacagtttatgcctactatattaaagccatattatatcttttgcagacttttaaaaacataatatgtggaagattacctgtataatgctctaactctcatttctcttccatttagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggtaagagatatactcttcacagtattttcttgagaacattttaagtgtctcttcatgttgaaaattagggaacatgatctgattttgtagcttagattatctacaatagaggctttataaaaaaaaaccctgaacaatagggttctttttacagatctcttaaatgggaacctaaacatttaaaatgatagaagtggaacagttttggttggcttagggctgggagacctggggttacctccttcttgccactatccccacttccgctgtggcctctgaggtacctctgtggaacccaagggcttcaaaatcatggtctgagtaccactagttttacttgtatccagcaagccaagaggaagtctgtattcttggtagtcctacttacaacatttttgtttggctgtaagacaagaatcccagatacacaaattcaatcgtcagggtccatctttatctggtccttctgtctgttgaggttgttgccaaggttccagcactcaggcccacagaatgcctctctgtaatatgctggtaccactgtcattgctgaggagaggcattgacttgcccaatcatggcactgtaggatcctgttctttgtctcaacatgtttagaacttttatcagtgctgaagacacgcatttgggaagaataatcagtgatgtgctggttaactggctctttgaaaatattttaaaagccctgatttgtactgtttgccagtttccatggtgtgaataccccaaccatggccaatttcaagcagccaagagtttaaaaactggcttgcaaaatctctgaaaattcaactgtcagctcctatgagctggtatgagctacttagcacaccaatgagtaaggaataacttgtataactaaggctccagagtgatttgaataatggatcaaatcttaaaatatgaaattgcctagggatgaatataagtcatgctcttacaggtcaaaaatcaactctatacacttagaatggggaagatgtggccaaacaagttgcagcatgtatgaaatagaaaggagtgatggtagtcaacaacaagcttactagtaatcctagtggccatgattgagaacttactattatccttacaaggactttatgaggttaggttttgtgttagtccagctcctctaagaagcaaatgccaagacaggattaaatatgcaagagatttaatagggggaatgctggtgagggaaaatgtggaaggagccagaagaggctgggagagctg[450 bp omitted]ttgaatgtggtaggaggagtgggatgaagtgaccaaaaagcttatctggtctcaggctatatttataggtctgtagatttcagttcagtatcagaagatcctggagttccctgttcaactctactggctactttccaagaggtcaaaacaaataatgtctagaagagaacagatgaaatgatgacagttctggaaagtaagaaatatgaggcattactaaaagaagcaaaggaattttacctgtaggaaaaaaagacttaaggggactcccatagttatctttaaacacttaagtaatctcctttacagaagtagggcatttgctacctaatctgcacgtcagattaagtataagacatcatctgggacaaataggtggaaataagcacaagtgaggaattttctaactggtactgttcaaacgtgctctaaagatgagtgccttcctgatgttccacactcccagtatgctgctgggcatatataggaggtccttgccaagtgtttattggactgggaagggagtagacagagagaagaaaaggctagaattacacaccattttttctctgttttttcttttttttgtttttttgagatggaatcttgctatgctgctcaggctggtcttgtactgctggcctcaagtgatcctcgtgcctcagcctcttgcgttgctgggactgcaggcacatgccaccatgcctggctttgctttttgtcttgaacatcctcacctaggaagtcttatttcttcactcactgcctcattcttcccttaagtccaaaaataacaggcaatatgagttcacaggtaacttatatggtggtctgtgcttgaagataaagtaactctgaaggcaagtcacgtggttcttttaagaataaaggctgctcatgaacttttctattttttataggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataaggtgaatttactttgtataattcttgacttgcctctcagccctccgcagtctgtgtttttctttctctagggccttttcttcttcatcttgccaccagttgtacattgtgcattcacacatgtgggcatgaataatggattcgtgtgacttggccacatgtcccatcacagaggccaggttcttgtctactctgtttacatgctgggttctcttctgcccagcatcacggattccaggcacaggcaggaggcagggccagggttgaatcaagtttcctgggttttctgctgacgctaacaatgttttcagaaagaaattcaacaactataggaaaggaagaaaaatctggtgccacacactgtgccgtcccagttaattggcacaggccaacagagaaggccaagacctgaacaaacagaaacctcaagggaactgaatagttgctgggtttacaacttcccataacagtagccacctgaggcctaaataaggatttaaggataaactggcaacagtgagctcaaagagtttttttttttgaaataagatggcagatgggtactgttactgcaagtgccattatggcaatgctgttcggtaaaaataacatattgataaaatcttgattttaaatgtggactagttcggtgtacaaacatgtttatttgggagtcattgcctaatatggaaaaatctatctggaaaattttattttaaaagtttacctataagtgataatatttatgtgccatttatatacatacagtgccaattttgtctcatttatatataaaatggctggggttaagttgctaagattgatgtctctgtgtacatcacatcattcatatcagtttggatcctctgagaagcagacgccaagacagaatgagaagtgtgagagatgttgtggtggaaatttctgagaaggataaagggggagggggcaggagtgggcaggggggaccttcagaccgggaggcaggttgaacccctatggaaggagagcgaaaggaaggaggaggggtgggtagggagagcctcagctgacaacacagctctgagaaagtctcaaccaggctgatggggagccccagagcacagactgcccatcagagaggtcccctgtcaggcaggaatcacctggttctagtccccctgctgtgctgtgtcattgggtgggaacagcttggggagagtgtggccccagcagcgacattgcctgtgaactctgtgtgaatccggaaggtatggcagctggagtctgtcagccaacaatgctcttctccacagggtctctcttgataggaggcctgagaagcgccctccatggctgccatgccatctctccatttgtagtcttagggattcaggttatcataaaaccttgaaccagtagctattcgaaaacactgaatctagatgagaaactcagtaattgggagtttagatttctggagaccagcaggcctggcttgggaacctgactccacattaatagctgagggaccttagatattgtatttttcctgaacttcagtttcttcatctttggaatgggaggaacaacagtgcctgtttgatagaattgctatgaagattagatgtgataatgtgtatgaagcgctgagctaaccatgaggcccatggtaagctcaatcagtgttgctattgtaaattagagttctatttctaatcagagggtgagcctataccttaatataaaatatatatagcataaatataagatataaaggtttttttttcctttgaggacaataaaagcagggtaggacattatctggaatcagcatcccaagtcaaaactgcattattttaaaactgcccttaacaaagacattctaagcagagaaggattgctatactatttaatatcagcctgaggaatcttttcaaaagagctaatagatcctgtcatggaaatagatgaaaggaaatgcaaaaaaagtgggaggagtaggggtctgcgataggtgccaaaccacctggatcattttctggtgggagagagggatctttagactaaattgccatcaatatttttattttaaaatttaatctcatttttggtctcttacctataattatttacgaccttatgtttcactggatgcaagaagtattcttaccaagtcaaaaagctagtcacaggataagagacaggaacagtggacggcccagagaatgactgtgcgagggttagggtgcttgcgtggatctttgatacccagccttgctctcatcagtgcgttgcctaatggacagcagttccagggggaccccattctaaagatctagagaaaatggagggctacttatccagttttgaatccccattttctccattaggatctcccaacatattgggccactatccaagggttagagggaggaggctgagatggaagcaggggttgttttctgatctctgtggcctggtgttccttaagctcatttccctcagagctggggcctatgctgatgtcagctgttgtccagaagctttaattgaggagatacaaagctagtcatgccttctcggtgttggtttctttgcaaagacaaatctgctaacttcatattcacagtgtgaagtccctttgctggccatcagcaagattgggctcctgaactgttaggaatatttaaatatgtttttcctttcatttcccccttacagtatcctttcagtaacctcaaacttgccctacaaaagctgaagcaagaagaaggaaaatccagagagctcaagcaggtatttaaagctgctgactctaagcacacaaatatggtggattataatacattcaggtaagccatattctgctaacaatcacctgttttcccctcaaggttgtccaaagaacagagagaactatttctttcctaatcagttaactattttttattaggaattggcatttctttgagtttgtattattttgtggtaaagttttggccacgaatactctagtaaatgttacgaatttacatataaaaggagtttgtacatgagaacagagggacaagagcatagaaagtcagctggtcacattgtcttatgaatcaggaggttgaaggatcagcagaatgccaggaatgatgcatctgagtgagaaagacagaaaaaagcaccgctaagagcacgtcctccctaccaaaatctgggggacaaaggagggacatctccaggaatgtgatgaagttggaaaatagtaaaaacttcaccgattatcagagcaaaggtgatatgtatgcatctgtgtatacatgtgcttacacacatatgtgtattctgaaagacatgaaaatataggaatcgagggaaaaatatatgacagtagttggaaatattataacaaatcatgattaagattttctctaaggtgaagctgaattctgggactatccagtggctgaccgaggcaaatttccaaacagcagaaacacagggaaattcaaattcagggtctagtacaatcgtgagacttcttaggctgaaaacaaagtgaatggagcatttaggagaataaattaaatcatggatggaggacaaaggggactttctctttaggctgagaattctggctcctgacaacgatagtggctgaaagctatatagtaaactccgcttgatgcagtcaagatgtgggctgagaaatgaggaagtgagcccaggagagggtagcagggaggtctttccaactttgtgtctgcagtcgcctattgcatcactacctggtggcctggagcccaccattaggcccagagtgtcccaagagctcatttgttgttttaacaaagctcttttgtgtctccaaaatgttctttggagagaagcagtcagaggacatatttttattgtttagaattcccaaccttctgggatcaataagaatttatagttctttgttattgttcatagtcacatacacatgttcatagtgttttggaaaataaatggagacagtaaagagcagagacaattacacaggccatgggctaatggaaggcagtggaggtgaaagcaagaaatttccatcagaaatgagggagtggtttcgttttattatttgtgtccttttacaaaagcatccatttttccagcactcgcaaagtctattggaaacactttagtgagtttatagggctttttgggaagcacttaggccaggcaggcgatccaaggaggaaaagttgctttgcagatggaggcctgaccctaattgtgggtgggataaagggccactacgctgtgattggaggggtggcctcaaggagctgcatgctctaaaagaaggacctccccgtcccagaaattccttaaaatgaaactcagatcaggtttcgcctggcttgaaaaatccttcagtggcttgccattgtcctcacaataagatccaaacatttgactgcagccagcaaggccttgagtgatgtgagtctgtttgtatttccagtgtcatcacctctttttctgcagccctgtcttttggccttactgactgtctttcggtttctcaaacacatcaagctctttcctgtctctgagcctatgcacaccaagttccctctgcctgaaatgcagtcaccaccatcctctgcatggcacactctaggactcatctcaaatgccaactcccagaggggctttcattcagaggggctttctagatcctatctagagtagatcacctgctgttattcttagccacttgtttatatttttcacagcacttagcacaacttgcagttattttatttagagatctgtttacttgggggtggggtatctatgtgtatgtgctgtgtgtgtcttctcctattcgaatgtgagctttctgagggtggggaactcaatggtgttgttccctgcagcatcccctactgctgggctcaatacatatagttactaaatgaaataatgaaccactagagttgttcctgggggttctagtttggaggtgatggcatggccttcaaatgagagcgtagaccaagagtctagatgtctcaatccatatgacatgcttggtgccggatgctgagccctctgtgcttggggctgctcatttgtgctcagcccacaaatggtccctgcaccttgtcttcagccccatcttatgcttttcaaactctttgagcaaagaaaaaggaactacatagcccgtgtctatcacatcataccctaattcaattctttgctcagtgcttttactagctaatattttcctttcattatgtatgcgtatgtgtgtgtgtgtttgtgtgtgtgtgtgtattctgactctcctcatcagaatataacctctttgagggcagggaccttctctttcttgttttctgctttagccttatgacttatttcagtgtctggcaaacaatagggtgttaataaatactagttgaatgggtacattttttttttgtttagtgtttaatatgcctcagatgaaataattctctgagataattctctgcttttgtgtcttttgtgttctaccttctctcttttctcttctccttccttccttccttccttcttctttttctttttcttttttttattatactttaaattctggggtacatgtgcagaacgtgcaggtttgttacctaggtatacacgtgccatggtggtttgctgcacccatcaacccatcatctacattacgtatttctcctgatgctatccctcccctaggtcccgaccccccgacaggccccggtgtatgatgttcccctccctgtgtacatgtgttctgaatgtgtacattttatctagccctcactgctttggctttgacctgtaggctgattgtgtccatgctagttcttcaagctcagacctttctcctgagctataaacctggaaacacgaatacctctgggacgtttccccctcgcatgtctcttaggcatcccagaaataactttccctaacttgacctcattttcttctttcataaagtagcagctaggagactgtatcctgataaaggccatcatgggcatccccaagagtccagaccaggtgttggctttgtgtctcccctctcccctctctcgacctctcccactcaccctttggaattatacgtcttgaactacctctgggaactttcccttctttacatctgcagcttcacggttgtagttcagcttttcatcactgtttacttggaccctctggagagcagtgtaactgatctctttttcttaactctcatcctgcaaagttttgccagagtgaccttcctaaactctgatcggatcattcttctgctcttaaccctgcatcagtgtgtcacatgagtttgcctacctttagctccgtatttccatctcactagaagaatacttttgtagaagccaccatgtattgagcacttactgggggctaagcatcgtgctaaatgctttatacctactcttcactggtagcctcctgtcaagttgttacttgtttgcttccctgcctccacatcagctcctgccaagtgcaatagatgtttgctgaataatttaatgaacgatcctatttctcaaggaacgttcagtctaaagcttgcagcaatcaagtaaataattgatttccttgcaccagggaagggccatctggctcttacttagggaagtaaggagaagctaggcctgatcctcactagccaagtaacttgggcaactcacttcacctacctgtatctcactcatttgttcatatattggtctctgaggtcccttctaggctctgacaactggaaactctgaaaatgtaagtttataatattcttgtaaaatgttctcttttcaaatttgtacattgagatagtagagaagagcagaggcaagcaaaggcaggactgcagcataggcctatgggcttggcctctgtggccctgactctcttctgcttagatacctggcactctcagcatacacctggggcttcggggcccagacctgctgctctgggcagtggtccaagcccccagcattgccctttttctcagagatgtgcatctcctctcagaaaaactttgagggtaggagctgataaactacctctgtataaggtgccatggtcaataatggattaatgtgtgggcctctcggagatatttgcctcagaatagacctgatggaatgcagggacaggcagccatcaggaaacagaagtagggaatggtttttgttttttttttttttaatttttttatttgggtagggaacatttctcttttgccttgtgggaattcaccacttctgcttctgtttcattgatcctctttagaatctttttggcatggtctatcagattcgcctgtgagagctgctgatcgttatccaagagagtgcagataacctttcttagagccttaggatagatacctggtggcagtggtgggcagatttcagcagggagcagggcagggactaagcttggcagggctagtatttcatgcagttgggaacataggcagggtggggcttcccagtgagggccctggactctgaaccacaggcagcagcagcagcagcagcagcactgagagcccaatgccaaggaagatgtggtcagtccatctctctggccacctccctgagccttgatctacccatcagagatgacacctggccccatgtagcctgtgtgtattttggttagctgagtgcttgtctcttctctccacctggggaagctctcagagggcagggcccatgcctggttcactcttgtgtctttcccagatgcctccagaacccagtgtatcagacctcaatgaacatagtgaattattacagattttttcttcaggtccccgttatcagttgcagagtcagtagctctcctgtgaacatccatgtaataaattccttctaagatttagaacctcaaggagattttctcccttgtaaaactaaaattcttcctaaaagaggtaatataatagaaatagttcttatcactggttttggagttggcaaacccagatctagctcttggctctcttgtttaccagcttagtggccttggggaagctgctgaataattttttcatctgtaaaatggggatagtaatacataggacacagctgttgtgatgaatacatttgatactgatattaaaattcttattgtagctgactagtgcatggtggatactcagaaagtgaaaatgctttatcccaatagttgtgaactggtgtcaccaacaacagtaataggaaggtacatcttgtttccagtatttcaataagctttatatttactcatggtgggggtcattcaaaacattctttaataaatgaggttgaaagagaaactctaaaaacttgtaggccttgaagatggaaaataataaacatcattgttggtggaccaaggctgggaaacattaatataatctaccctattgctgtcctttacttcacggaagcaaattgtaaatttagtgcttagaacatggtaatgatctcatcctgatttatctaggacaattatctctccttttatatggttttgccctatttttatttggactactctgtgtacattgctattggtgttttttattgtaagcaatctagcatcttttaaggaagccactagtctatgaatctatatgaacaaaagcaaaaacaaagacaaataaaatcccaaagcactcaaacataggttcttatcatgaactaaatagattcttggacagtattcatagcctgtcttcaaaatggaaatttccatatatgtttttgaaaacagcattttgaactttcctaaaagcattaaatataaataatgtgatgttgtagaaagaatgctagcctgggaatcaaaaagatggagatctttgatttgattctgtcactgtctggtggtggtgtttgtattggtgagggcttagttttaaaaaggaatatcctctctggctagttaagcaaaaaaaaaaggaatttattaaaaggagcctgggtggttcacagtgtctttggaagggctggagaaacaagctcaaggctgaactataggaacagtgcccaaaacagggctgtagaacttgtctgatgagaaaatgacctctgttaccaccacccatgactcattgctgcacttgcattgctgccaagaacttgattttaccacagccataactaccactatttctggcaatcgtcctttaccacccctgaaggctgggctcctttgacaccaaacgtggcccaccctgagctgcttttcttctgttaatcccttctgaggcacagtcttaagtaagcttccctgattggtagagagcctgggtcacctgcatatttctaactgcaaggaagtctgggaaattgagctctgacctctatgttggggtggtaggaaacttacgtgggaatttccccaaatatagaaaggctatttaaaagatagcctttgtagaaagtttcagttagacaggatgaataagttctggagatctggagatctattgtacatcatggtgactatagtgaataatgatgtattatatacttggattgctaagagagtagctcttaaatgttctcaccacaaaaaaataagcatgtgaggtgatagatatgtgagttagcttgagttaattacttctaaatgtatacctgtatcaaaacattacattatgtgctgtaaatatatacaattttatttgtcaattatactttaataaagctggggggaaattgaataaataaaagatacccttttcatttgccatgaatattgcagggatagtaaatccaaaccaacatgagccaaacagggaacacgaatatatgttgacaacagggacaaagcacctacctagttttagtactttgaaaatattgttttgactcgccaagcagctaaacaagaggcaaagccctcccctacgcttggctacttttgcaatctctgatgaacttttctgagtttccattgccttaaatgaaggtattggattaaaaacaggtttataggttgaaagctggcagttatattttgtatggcttttgtttaatgtttttaaaattgggagtttaaacctaagaatatatatatctggtgcctcttggaaaatagaaattggacccacatttctctatggcaacaatcttttgggggtgaatggcacttgccctccttagatagagcctgttctctgcatttcttctcagtttctacaagtccttattgtctcacgctaaggcactttctcctatttatcttacatacctaccccagtaggtactagactaggtaattcttggattagatcatataaggcacctcccagacataaaattccattattttgttactctaggtattgtggaaataggcatttaggaatcactgtataaatagttcaaaatagaactgaagactaattttttaaaattagaatccaaatatgattgtatacttggaaaatccaaaggaatcaattttaaaatggttggaactattaagagtattcaggaaagtagctaaatataagaaagctatatatagaacaatagctttactttatatcagcaataactagttaagaagtgttctgaaaaggggaatactatttgctgtagcaacaaaaatgaaatatctgggaataaattggacaagaagcgtgagactaaaatgaatgcaatttttaaacttgatatctctgaatgggaagacaatattgtgaaaattctaattttccaaatttatagatttgaagcaattccaatcagaattgcacagcaggtttttgctcttgctgttgttagatttggttttgtttaacagggttaagggagataaattgactgattgattatgaaggttcatcaagaagaataaggggttgagaatatccaagaaaatgttgaaaagaatattaaaatgtagatactagaaaggtatatgatttacatacatttgaaaacattttctagcagagaaacaaaaatatcagtgaaatacagtgtagagtctatagaagagctatttttatgaactttcgtataagtatggagaacatttcaaatcagtagagaaagaatggattattaataaagatttggtgacagtcaactagaaaatgcctttatacgcttattttgtggtggagcacagtttccaaaagccataaaggaaagattatattgactacagaagaattttatctctctctatggcaaaagctatcacaaacttaaaagacaagggacagactaagagaaaatatttataaccagtgtaagagccaggggattaacattaagtacttaagaactcctataaaatcaacacacaaaaatggatcaaaggcaggaatagttcacagaagaaatacaaatagtctttaaacctatgaaaagatgcccaataatgacacaaactgaaacaatgatgaaatattatttccacttactatattggcaacatttaaaaagaataatataactgactccaggtgaacatgtgtggtaacaggtactctcattttccactgataggagtttaaattggttcagcattttggagggcaatcggcagaatgtgtctaatgtttagactcttacctggtagttgcacttgtagaaattttttatttgaaaaaaatttggacaggtggattgataaatatatgtgtatgtgcatgcacaatatttattgcagcaaattttgtaatagtaaacatttagaaaaataaaatgcccaacaatagggaaatagttggatatattctattgcattaatttcagacaatattttttagccattagaaagaggtagaccacataggcataacagaaaaaatgtttgatgtatcagttaggattgtctaagtaatgctgcagtaacaacaacccctgaacctcagggaattaaaccaaccaaggtttattgtttgctgactttatgtatccattgtggttgtcaggggaattttgttcatagtagccactcagagactgaggctgacagaatagccactaccttgaatgttcgcagtcacattgccataaaggaaagagaattttggagggtcaagtacaacaaattcttacttggcaagaaatacatatcatttacactctcaatttattggctagcactagtcacaggaccccactcatgtgctcagaagaaggagggaaaccagatcttggtgaacagctatgagtggctaccacatatgtgttgtgctgttttgtagataaagcaaaatccagaagtgtgttaatatcctacttatgccaaaaatgtaaaagttgtgtgtgcatgtatatttatataaatatttcaaggaatgtatatcctttgaagaaatgctagcaggctacacacgaagctattagtggagtatgcttcattccttgatttttacttttttttacaatgagcaattattttttaaaacttcaatttaaataaaataaaacccaaacaaataaaaccaaaaagcctgggaaaagagcttatggaacagtttttcagaaagaacattttttatttcttgcttcagtttccagaaacagctaatggcagatgctggcagaatgttctgagcaaaagtcaagaggcttggaatcatagagtagcgcacaggttgctgtagttggtactctacctactctgattattgactacagtcacataattgtaatgtgcttacttaaaattcttattttaggggccacaatattttatgtttctgcaattacaaagtttcagaggtttaaagttaagttttgagatgaaatagtttttataattttcaaattcctatcaaattagcatgttttacccattcattttctccaacattttatgaaaattttaaaacatccagaaaatttggcaagattaaacagtggacaccccatatatccaccactgtgccattaacctcttaactttacttgctttgtcacacatctctccatttatacattcttatatccatctattaacccatcttaattttcgtgcatttcaaagaaaatcatagacatcagttacctccctctaaatattttagcatgcttactatttatttatagtttttcttttgatgtgaaatttatgttcaataaaatgcacaaactttatacatttgctgggttttgacaaatgtacgcttgtgcaacccagatccctactaacacatagaacattaccatcactccagaaagttccctcatgctccatcctagtcaattcctgtgcacatctgccattcaagaggtaactactgttctgatatatatttttttcactttaggtgctttttttttttttttaactataggtggtttttctctgttctagaatttcatatgaacggaattatacagtgtgtactcttttgtgacttctttcgttcagtatgattttgagattcattcgtattatagagtgtatcactaattcctttatattactgagtagcattcaattgtatgaatataccaccatttgttgattcattcccctgccaaagggtacctgggttgttttcgatttggggctaatatgaataaacctggtctgaatattcctggcacaaatatttttgtaaacatgtgtttttatttctcttggttatacctaggaatggaattgctgggtcatacataaagtaagtgtgtgtttagtgttttgagaaactgccagaccttttaccaaagtggttgtatcagtttacatttccaagtccacattgtcagtcttttatggttgttgctttctgtgatctgtttaagatgccttcggctggctcaaagtcgcctaggatagtctcctatgtttccctctaatagctttatggttttagctttcgcttttaagtctatgacttatctcaaattaaattttgtatatggtgtgaagtagggatcaaggttcatcttaaattcttaaaatgcttatttggaattcttatattatgggccagcatattttatattaaagtaaagaaaaaaataattctagagctttagaatataattttgaaatggaagagttttcataattttcaaattcttatttaattactgatgtcttacccatactttttttttcttattctatggtatagttttgactgttaaaatatcaaaatctcctttgcaaaggaagctaaaatactggccttttatgttttctcaaatcttatagttttcaatagtttccttatgtaatacattcgtatttcttaaaaattgaagtattctcactaaaataatatcttagttaactgaggaatgctggataccaatgatcttattaactgaaagaaactgtatactacacatatagtggattatattttccaaagattgcttcaacagtatctcctatccaacatgctcccctataatgtgaacttgacccttcttcttctgagggatagggctatgtcatttccccttgaatcttttttaatttacaatttcttatttttgtgggtacatagtaggtgtatatatttatgggatacctgaaatgttttgatacaggcatgcaatgcataataatcacatcatggaaaatggggcatcctcttaagcatttaacctttgtgttacaaacagtctaatgacactctaagttattttaaagtatgcagttaaattgttattgactatggtcaccctgctctgctatcaaatactatcattcattctatttttttttgtacccattaaccatccccacctgctgccctcccctctcccccactaccctttctagcctctctgataagcatccttctactctctatctccatgggtttgcttgttttgacttgtagatcccacaaataagtgagaacatgtgatgtttgtcttttgtgcctggcttatttcacttaacataatgagcaaatttcattctttttttttgactgaatagtactccattgtgtatgagtaccacgttttccttatttacttacctattggtggacacttaggttgcttccaaatcttggctattgtgaacagagctgcaacaaacatgaaagtgcagatatctcttcgatatactgatttcttttcttttggatatatacccagcagtgagattgctggatcacatggtagctctgtttttagttttttgagaaacctccaaactgttctccacagtggttatactaatttacattcccaccagcagtgtacaagggttctcttttctccacatcctctccagcatttgttattgcctgtctctcgggatatgagccattttaactgggataagatgatatctcattgtacttttgatttgcatttatctgatgatcaatgatgttgagcatcttttcatatgcctgtttgccatttgtatgtcttcttttgagaaatgtgtattcaaattttttgcccatttataaatcatattattagattttttccctataaagttgtttgagctttttatatattctggttattaatcccttgtcagatgggtagtttgtagatattttctcccattctgtggcttgtctcttcactttgttgattgtttcctttgttgtgcagaagctttttaacttgatgtgatcccatttgcccatttttgctgtagttgcctgtgcttgtggggtattacccaagaaatctttgccccgactgatgtcctggagagtttcccaatgttttcttgtagtagtttcatggtttgaggtcttagatttaagtctttaatacattttgattttatttttgatttgatatggtgagagataggggtctcatttcattcttttgtatatggatatccagttttcctagcaccatttattgatgagactatcttttccccagtgtatgatcttggcacctcccttgaatctcgagtgggcttgtgactcatatgtaaccaatagaatatgacagaagtaatgctgcgtggcttccgaggccaagctagaaaagatgcaggttgtgcattgtctgctgtgacacttccctttggagtctgagctactgtgtgtgtaagaggtcctgccaccttgaggctactatgctatgaagaagcccaggctacacggagaaaccaaccacatgtgggtggtaatttgattgagagccccagctgatatctcagctaatggcccttgtcaggcataattcaagcctccagttatagaatcttccaagttaaagctccagacattcttctgtgctctgtctgaattgctcactctcagaaaccatgaaaatagcaaaatgggtgttattagctgttaatttttagggtagtttgttaaaaagcaatattaactggaacagcatacatcaatgccttccagggaaatgaaatactgaaactatactgcattcacacgaagtatttaatttttggttatttggagaacaatttgatatcctttagtgcctcaaggtcatggctttccagttttttaaatgcaggggtagagaaatctcatgccacatcttggaagaatctcttgttcaaagaccttcccttgtcatacatataattaaaatgcagaaatatgtatgtatgtggatatatatagatacatacacacgttgtgtgtgtgtgtgtgcacgtcaagattctttgtacttgtgtcttccatctgcaagaacagtagggaatctcttcctttcacctgaattcagccaggtgaggtggaggcttttgtgagtttagatgtgttttccatccaaagaagatgtggtctccttttctaagaccacatttgatttttaaaattttaatttaaattatattcatatacaataagattcacttttttggtgtacagttctggttgtgatgccttcctagagttgtgtaactgccaccacaataaagatacaaaacaattctatcacgctgccttcccccttccaacacccaccacccccccccaatggaagtatgctttctcttgagtaaacacataggagttgaatgtcttgatcatatggtaggtgtatgtttaaactttgtaagaaactatcatttttttgttttgttttagaggttttctacatctttcattagatttttccctagatatttgatatttttggtgctattgagtggcataatttttagtggttgctctagagtttgcaatatacatttacaactaatccgaattgtatcagtcagttctcacagtgctatgaataactacccgagactgggtcatttatgaagaaaagaggtttaattgacttacagttttgcaggctatacaggaaacatgactgggaggccttaggaaatttacagtcatggcggaaggtgaacgggaagcaagaaccttcttcacagggtggcaggaaagagagagagagcaagcggggaagtgccacatgcttttagaccatcacatctcttgagaactcactatcatgagaacagcatgagggaaatctgcccccatgatgtaattacctcccaccagttccctctcccaacactggggattataattcaacataagatttgggtggggacacagaaccaaaccacatcataagttcagtttcagataacactatactagcttcaccagtaggcaagtactccttcccccttctcttgtatcattgctgtcattcatttcacttacatataagcatacataagtataaaaccatgcataatcaaatacattgttgctattatttgaacaaacttttatgatagatcacttaagaataagataaataaaagcttttacttaccttcacttactccttctctaatgcactatctttccttatgtagatctaagatttttacctagagaattcctttctcttcgaagagcttcttttaacatttcttgcaaggcaggtctactggcaacaaactccctccatgtttgctgagaaagtctttatttctccttcactttcaaaggaaaaatttcacaggatacagaattttagattggtggtctttttctctcaacactttaaatatttcagtgtactctcttcttgcttgcatggtgtctgagaagtcagatgtaattcttacctttgctcctctatgggtaagatttttttccctgtagcttctttcaagatattttctttaactttcatttcctacagtttgaatgtgaaatgcctaggtgcagtatttttgttttggtttggttttggtttgttttgttttcggcatttatcgtgtctgttgttctctgagtttcctggatctgtgatttggtgtctgacattaatttagggaatttctcaatcattacttattcaaatatttctgctgttcttttctctctttcttctccttctagtattcccattacctatttgttacactttttgtagttgtcccacagttcttggatgttctgttccattttttttgtcagtcttttctctctttgcattttggttttggaagtttcttttgacataacctcaaggtctgagattctcatccatgtccagtttactaccccattgaaagtattcttcatttctgttatagttgtaaaccaaaaataaaattcaaagccccccacctcatctggatggatccctcctctcagcaagggtatccctgagggactaacttgagggactagttcaggccatgatgaggggcaggggtcagacatacttcattataccctcttcccttttggaattactgatagaacatactcttcaagtctgatgagaaacgtgtacaatctattctctctgaagcctgctacctggagccttcatctgcatgataaaactttggtctccacaataccctatcattgtaacccagacatttctttctattgattcaggatcttgagataataacgtacctctttgaactaattgcccatcagaaaattttaaaatctacctataacctagaagccctcgccctttgagttgtcctgccttttcagaccaaacaagtatatcttacatgtatttgattgatgtcttacgtctcctttaagtatataaaactaggctgtgcctcaaccatcttgggcatatgttctcaggatctcctgggggctgtgtcacgggccactggtcactcatatttggctcagataaatctcttcaaatattatagaatttgacgctttttatcgacatagtgttgttgattgctagcatttctttttgagtttttcttagaatgtccatctctctgcttacattattcatctattcttgcatattgtctaatttttccactgtaactcatagcatattaattatggttgtttgttttaaattcctggtctgataattccaacttctctgccatatctgagtctgattctgatgctttgtattttcaaactttttttttttttttttgccttttagcataccttgtaatattttgttgaaagccagacatgatgtactgggtgaaaggaactgtgggccaggcacagtggctcacacctgtaatcccagcactttgggaagccatggtgggcggatcccttgaggttaggagtttgagaccagcctggccaacatggtgaaacgctgtctctactaaaaataaaaaaaaaatcagcctggcatggtggctcatgcctgtaatcccagctactccggaggctgaggcgggagaatcactggaacccaggaggcagaggttgtagtgagcctaggtcgcgccactgcactccagcctgggtgatagagtgagactctgtctcaaaaaaataaattaaaaaaataaataaaaggaactgtggcaagtaggcctttagtgatgtgatggtaaggtgtgggggcagggaaatattctctagtcctctgattaggtctcagtcttttagtgagcctgtgcccttggactgtgaagtaccctcagttcctcccctcccctccccctactctagatgggaccggatgtctggaggggactggagtcacgtatttcccttcccccatgtggatggctagagcaggctgcagttgagtgttacccttaccccaggttgttaggctctgataaaaccccagtaggtcaggctcgtggttactttgctactctctctgccagaagtctgaggacatattttttaatagtcactgtgagaacctgatggagatcgtggaggtaaaattcacttaagtgcaggctcgccgcccaacccccctcatccactttgactgggccgtctacagttttaaaaggcattaaaattttttttgttcttttttagaagtggggtcttgttacattgcccagactggattcaaactcctgggcttaagcagtcctcccacctcagcctctcaagtagctggcattactgtgtcctgagacctcaagagtttttatccctcaggcatatccacattgagcctccagcattccaattacagtccagagttttctacctcagtactggttcccacagaggtttctgctccagtaaattgtgattctctgtatgttcctgcttgtctgtctaattttggggacagtgatttgccctgtgacttcacttctctgacagatctaagaagagttcttgatttttcagtttgttctttttttttttttttttttgagagggagtcttgctctgtcgcccaggctggagtggcgtgatctcggctgactgcaagctccacctcccggcttcacgccgttctcgtacctcagcctccccagtagctgggactactggtgcccgccaccacgcccagctaattttttgtattttttttgtatgtttagtagagacagggtttcaccatgttagccaggatggtctcgatctcctgatctcatgatctgcccgcctcggcctcccaaagtgctgggattacaggcttgagccactgagcccggccaatctttttttattttttcttttttacttcccaaactgttttttgtttgtttgagatggagtctcactctgtcgcccaggctggagtgcaatggtgcgatctcagctcattgcaacctctgcctcctgggttcaagtgattctcctgtctcagcctcccaagtagatggaactacaggtgcacaccaccacgcctggctaatttttgtatttttagtaaagatggggtttcactatattggtcaggctggtcttgaactcctgacctcaggttatccacccacctcagcctcccaaagtgctgagattacaggcgtgagccactgccctggcctccaaactgttttttaaagtagttgtatatttttcttttttaccaggagtcttggagagttctagtacctttacatgcttatcaccctcgatatggtctgtcttttaaattttagctatcctaatagctgtgtagtagtatctcattgtgattttgatttgcatttccctaatgattaataatgttgaacatcttttcttcacttatttgccatccatatatctggtgaactacctattcaagccttttgtccatttttagtttctcttattactgaattttgagagttttaaaagtatgtgctggataccagacctttatcagatatatgattgccaaatgttttctatttctctgtggattttattcttttaaaagtgtctttcaaagagcaaaagttttaaattctgattaagtcctatttatcagtttttgcttctatggattatgcattggtattgtatctaagaagtcttggcctaatccaaggccacacaggtttcttttctactgtattttcctctagaagcattatcatttcagattttatatttagggctatgatccactttgagttaatttttgtatgggtgtgaagtatttgttaaaaagttttgctcgtttgcacatggatatgcaattttttttagcatcatttgttgaaaagactatcctttctccactgaattgccttgttgaaaatcagttgtccatgtaggaatgggcctatttctggactctattctgtccaattgacgtatttgtccattttgataccaataccgcattttcttgattactgtagctttgtaagtcttgaaatctgatagtgttagtgctccaactttgttcttctttttcaaagttattttggctctatactggatctttgtattttcttttgaactttggtatcagcttgtcaatttctataacaaaccctgttgggattttgattgagattgcattgactctacagataaatttggagacaatattgagccttttgactaatgaacgtggtatgtctctccatttattttggatttcctttatctcagaaatgctttataacagtggtcctcaacctttttggcaccaggggccggtttcatgaaagacagtttctccataggcccaggtgtcatggctgggagatggtttcaggatgattcaaacacattacattcattgcacagtttatttctattattattacattataatatataataattaatgtagaatcagtaggagccctgagcttgttttcctgcaactagagggtcccatctgggagtgatgggagtcagtaacaaatcatcaggcattggattctcataagtagcgtgcaacctagatccctcgcatgcacagttcacgaaaaggtttgcactcctatgataatctaatgttgctgctcatctgataggaggcagagctccggcagtaatgcgagcaatggggagtggctgtaagtacagatgaagattcgcttgctctcttgcccacccactgctcatctcctgctgtgcagcccagttcctaacaggccacggactggtaccagcccgtggcctgggggttggggacccctactttatagtttttagggtatagttcttgcacatctcgtgtcaagcttgtcactaaatattttatttttgatgttttcataaatataatgttttaaaatttagtttcttattgtatattgctaatatatagaaataagattgatatttgtatattgatcttatattctgcaacattgctaaactcatttattagttctggtaattttcctttttattctatcagtttttctacgctgatggtcctgtcgtctgtgaataaagacattttcacttctttattttcagtctggattcctttgatttctttttgcttgctttattgcactggctaaaagtgccaatatggtgtgttttgtcacatgaaagctttaaatttttaattatacttgaatttgtccatcttttcctttatgggtttgtgaattttgcattctgtttaagaaattatgtatgccccacatatatgaagatattcttctccattttcttctaaaagttacaacatttgccttccacatttgggtcttaaattaatctaagattaatttttgtgtctaggttaacacacacacacacacacacacacacacacacacacacacacacacacacacacacacacacacacagattgccaatcaacccagtatcatgcattgtctgtcctttccccagtggtttgtactgatacatctgacatatgtcatggacccatatccatatgaattggtttctaagccctccaattttattaagtttgtttgcttgtctattcttaaatcagtattatctgttttcatttattactatagcatcatgatatgtcacgatgaaatataagcagggtaagttctaatttttcttcagatttgtcctatttgcagacttttaattttccatatgaactttatgaccactttttctagctctatgaaaaggtgattgtattttgattggaattgtgttgaatttatacattaatttgaggacagaaatttttcacaaaaattttagattcagaaggtacatgtgcaggtttgttacatgtgtattttgcataatgctggggtctgggcttctactgaccttgtcacccaaatagtgaacatagtactcaataggtagcttttcaaccctcgccttcctccctttctccccctttttggagtcctcagtgtctataatttccatctttatgtatgtgtgtacgttttgtttagctcccacttacaagtgacaatatgtggtatttgattttctgtttctgcatcaattcacttaagataatggcctctagctgcatccatgttgctgcataggacatgatttcactcttttatttatggctgcagagtattccatggtgtatatgtaccacactttcttgcactgatatgtttataaaagtggtattcacaataaccacctcatagaatcaacctaggtgcccatcaacagtggactggataaagaaaatgtagatttcttttcctttgggtagatacccaataatgggattgctgggttaaatggcagttctatttttagttatttgagaaatctccaaactgctttccacaggagctgaactaatttacattcccaccaacagtgtataagcattcccttttctctgcatccttgccagcatctgttattttttgactttttaatagccattctgactggcgtgagatgatatcttatttgattttaatttgccttcctgtgacaattagtgatgctgagcattttttcatgtttgttggctgcttttatgtctgtctgcttttgagaagtgtctgttcatgttctttgcccactttcgaatgttgttgttgttgttgttgttgttgatttaagtttagattctgtatattagtcctttagtcaggttcatagtttgcaaatattatctcccattctgtgggttgtctgtttactccattgacagtttcttttgctgtgcagaagctctttagtttgattaagtcccgtttgtcaatttttggttttgttacatttgcttttgaggtcttcaatataaattctttgcctaggcaaatgtccagaagaatttttcctaggttttcatagttttaggtcttacatttaagcctttcttttttttttttttagagacggagtctcactctgtcacccaggctggagtacagtggcatgatctcagctcaccgtaacctccgcctctcgggctcaagcagttctcctacctcagcctcctgagtagctgggattaaaggcacatgccaccatgcccagctaacttttctatttttgtggagacggagtttcaccatgttggccaggctggttttgaactcctggcctcaggtgatctgcccacctctgcctcccagagtgttgggattataggagtgagccactgagcccagccacatttaagtctttaatccatttttagttcatttttgtatataatgagagttagggatccaattcatgtctagccagttttcccagcaccatttattgaagagggtgtcctttctctattgtttatttttgtcagctttgtcaaagatcagttggttgtgggtatgtggctttatttctgagttctctattcttttccattgatctattagtacgtgcctattttttgtacaagtaccatgctgttttggttactatagccttgtagtattgtttgaagttgggtaatgtgatggctctggctttgttatttttgcttaggtttactttggcttttgaggctcttttttggttccatatgaattttagaaatgtgttttttctaattctgtgaaaaaaatgacattggtaatttgataggaattgcattgaatctgtagattgctttgggcagtatggatattttaatgatgttgattcttacaatccatgagcatgggatgtttttccatttgcttgtgtcatctatgatttctttcagcagtgtttcatagttctacttgtaggggtatctcaccctttgattaggtgtattcctaggtattttattttttgtgtctattgtaaatgggatttcattcttcattggttctcagcttgaatgttattggtgtatagaaatgctactaatatttgtgcagtgattttgtatcctgaaactttactgaagtcatttttcatgtctaggagtctattggaggaacctttggagttttttaggtgtagaatcacattattggcaaacagagatgatttgactgcctttttccctatttggatgccttttatttctttctcttgcttgattgccctggctaggacttccaatactatattgaatagaagtggagagagcggacatacttgtcttgttgcagttattaggggaaatgctgccaacttttgtcttcctgatgtaagcctttagcactataaactttcctctgaacactgcttttactgtatcccacaggttttggtatgttgtgtctctgttttcatttgtttcaaataattttttgctttaatttcattgtttacctaaaagtcattcaggagcaagttgtttagtttccatgtatttgtgtggttttgtgagttcctcttggtactggtttctaattttattccactgtggtccaagaagatgcttagtagaattttgatatttttgaatttattgagacttatgactgagcacgtggtcaatcttagagactattccatgtgcagatgagaaggatgtatattctgtggttattgggtggagtattctgtagatgtctattaggtccatttggtcagaagtccaacttaagtgcagagtttccttgttagttttctgcctcagtgatctgtctagtcctgtcaatgggatgttgaagtcctccactattattgtatggccatctatgtcttttcttaggtctagtagtaattgttttataaatctgggtgctctgatgttgagtgcatatatatttaggatagttaaatcttcttgttgaattgaacgcctcatcattatatagtgcccttctttgtccttttttaatgtcgttggtttaaagttgttgttggttttaatgttgttggttttatctgatacaaaaatagctacctctgctctattttgttttccatttgcatgatagatctttctccatccctttactttgggcctatcaatgtcattacatgtgaaatgggcctcttgaaaacaggagaaggttgggtcttgtattttttttttttaatctaatttgccattttatgtcttctatatggagcgttaaggccatttatattcaaggttagtattgatatgtgaggttttgttcctattgtagtgttgttagcaagttgctttgtagtatcaattgtgtagttgcttcataaggctctcggctttatacttatgtgtgcttttgtggtagcaagtattgttctttcatttccatgtttagaactcctttaaatatttcttgtagactggtctggtggtgattaattcccttagcatttgcttgtctggtaaagactcaccttcgtttatgaagcttagtttggtggggtatgaaattcttggcttggatttattttctttaagaaggctaaaaataggtctccaatctaggaggtctactgttagtctgatgggattccctttacaggtaatttggcccttttctctagctgcttttaaaatttttccttatgttttgacctcagatagtctgatgactatttgccatgggagtggttgtcttgtatagcattctgcagaagttctctgaatttcttgtatctgcatgttgacctctctagtgagattggggacatttttctgaattatagcctcaaatgttttccaaattgcttgctttttctccttctctctctcgaatgccagtaagtcataggttgggtcactttacataatcccatatttctcaaaggttttattcatttttaaaattatttttccttattttgtgtgactgggttaacttggaagaccagtctttgacctctgaaattctttcttctacttgatctagtctattgtcaaggcttcaaactatattttgaaattcctgtagtgaacttttcaattccaaaagttctgtttggttctttcttaatatatctatttcatctatttcatctgtcatttcctggatcatttttctgttttatttgtgctggatttcaactttctcttggatattgttgagtttccttgcaatccatattttgaattctttatctgtcatttcagacatttcaatctggttaggatccattgctagggagctagtgtgatcctttgcaggtgagaaaacactctggttttctgtactgccagagttcttgtgctgattcctgattccttctcatctgaggctgttgctgctttttttttttttttttttgggtttgctaccatttcagagggctttctaaaaatttgttattcttttttcctttgagggtatgactgtggtgtatgttgtgtgtgattgattggcttcatttctgggtgctttcagggggcaaagctctgtacagtttccttggttgcagataggttctgtgctgtggctttgtcagatgctgcttattgtagcaatgcatttttgtttggtggtgcagttcaggctgcagtacagtagatggtgcttaagagtagcagccagtaggtaggttggtgtccaggtggacgcacctgccctgatggtggtggcaggaagagatgatggtgtgctaaagtcttgggggaccaggcttggtggctcacacctgtaatcccatattttaggaggccaaggtaggagaattacttgaggccaggagttcaaagccagcctggttaacatagtgagactgaatctctacgaaagaaaaatttaaaaattagctgagtgtggtagtgtgcacctgtagttccagatactggggaggctgaggtgggaggattgcttcaacccaggagttcaagactgcagtgaaccatgaccatatgactgcattccagtctgggcaacagatcgagactctatctcaaataaaaaaatgaagtctcagaggcgggtttggggagtgcaccagcttcttgtcttagaccagcaggaatccatctattttcttatcatgtcactctcaagggctcacgacctgtttgtaaaggttttgtcctttggttctatgccactgtgtggctgtgggccgtgaatccacctttctgatggctaccattagagtgggggtcagagcagagcctattcccacagtccagggagggtaactccgaggtctgtccttcattgctagggcactgccattctgtttagggagggggagttgggccttacactttgtgcaagcacaagcagacacgggcttgctttcagtggggttggagctgtgggaaaagtgtgacaagcactttctttcagtgtgagctcactttcagcaggggtagagctgctagaaaagcatgaaaagtgctttctttcagtgtgctctgactttcattggaggtagagcttccagaaaagtgtgaaaattgctttctttcagtgcacattcactttcagggggaatggagccaccggaaaagtgtgaacagtgctttctttcagtgcatgctcatggggccctggtggggagatctgctgctgcatctccaacagttactgggagaggggtgagagatgacccgtctctccatatctgttcccaggcatcagtaatatccccttcagcagttggtaccacacccatcattcctttgtcccaaagaatgctttggtgggctgtgctcccctctcccttaggggcagcccacaatgaaattagatctccaggggacctactggtcccctgtgcttgccaaaattatagtgggttctggggtatgtttgtgggttgtctggtggtgcagtggctcaaatgcagaggatccctgggcacggcagtgacaccacatgtgcacagctggtgtggtaccctccatctcagtttcagtctgagagttgtgtggcatggctgcacaagctggccacctgattttggggacataatttctgtcactttgaaatagaaacttctcatccataaatataatgtatcttgttttataatactttatagttttattgttattgtagctggtatatttactttaaaattacattttctagttggtggtatgtatgaatgctattgttttcgtttgtttgtttgttttttgtttttgatggaatcttgctctgtcgcccaggctggagtgcaatggagcgatctccgctcactacagcctccgccacccgggttcaaacaattctctgcctcagcctcccgagtagctggaattacaggtgcccaccaccacgcccggctgatttttgtatttttagtagatacggggtttcaccatcttgccaggctggtcttggactcctgaccttgtgatccacccgattatgttttgtatattgatctcattttattttttgaattctcagagtctgtagattcttttggattttaattttggaccatattatataaactataaataatgacagatttgcttcttcctttctaatccttatgatttttttttctatttttattatattggctagggcctacaatgcaacatgtgagtagtaatagcagatctccttgtctttttccttaccttacaaaagatatttttactaagtacttagcttattatgagtttttggtagatgcagatattttctttaggattttcacatctttattcataaaggagataggtctatactttttctttctcataccacctttgtccatgtcaaatgtgtgttttataattgcttcataagatgagtttcagaacattcactgtttcttaaagcagcttgtaaaatgtaggtattgtcagtttttttaaggttttgtgtaagttgtctgtaaaaccatatggcccttccttttttcagtgggtagatttttaatgattcacttcctctaatacattttattccagatttctatttcttcttgagttggttttgaaaattatgtagcttctagaaactttcccatttcacctaattttaaattttttataacctttttagtcctgttactgttgatttgtaccttttcaaaaaatcaattttactagagttgttttttagatttttttaaacaaccaaattttaacttgttaaccctctttttaaactttgttttctatttcattaattcatcaatttgtattcttatttttatcatgttgttctttgtactttttctgtgtttattttctaacttcttgacttgaatatgtgtttcactgattttcagtgtttcttttctaagaaatgcacttaaggctttaatttgccttctgagtattactttagctgtggtgtatttagtgtttattatcctccatatataaatattttctagtattatttcttttttgaccaattagttatttaaaagtttgttttgacatttccatatgtgtatgaagttactctcatttggttcttaatttctctttttattacgtttagttagagaacattgtctgcatcttcttaattctttgatatttaatgagacttgcttcataaacctgggaattaagtcttaatttctgcaatgcatgtatttttctcttacttttgaagtttaaacgggtacataattctagatttaactattttcctttgatcttttgaagatactctattgtcttttgcctccattgttggtacgtctcttgttaatataattgttcctttgtagtcataagcctttattccctctggctgtctttctttgtttttggtgttctgcagttttattacaatgcatcttgggactatttataattcttcagtttgagaattattctgagccattatctcttcaaataacttctcttgttcattttgcctgttttccttctcaaactctcaacctgttcttgttatctcttaatatcctgtcaaactcctcttttttctccatgtcttttgatctttcattcttttcatttatttttcattctgtgctgctacatttctggaattttccttaaatctcccatctagttcattgattcagtgactctgccttcttattctttaagtactatttaattgttgtgtttcatgtttccatccttttccgtagcatcttgttcttttcttatggcttctctgtgttttatctctttaataattttaaacatcataatttcatggttcattactgatttttgttctattgtcccaaattcatggaatgccaatttttctgttatatctgctgacttagggtggattgtttccttttgttttctgagctcatcttaaattggactttcttcctccacttcattgttcctttgttgcttgggttgaccatttagagtagtttttaaaaaatcttttattttgaactaattgtagacttacagaaaatttaccaaactagagttcccatatttccctcacccagctttttctatgttaacatcttaccacagtgtaattattaaacccaaacaattaacactgggacagttctacagactaaaaacttcatttgaattttaccaatttttcactgtcatttttctgtcccaggatcctatccaggatcccacattgcatttagtagttgtttcatgttagtcttctgtggtctgtaacagttcctcaacctttctttgtcttttatgaccttgatactttttaagaatagtggtcaattattttgtagaatgttgttcaatttggagttgtctgatgttttctcatagttggactgagattatacacttttggaaagaataccacagaaatgatgttgtctccttcttagaacatcatatcaagtggttcatgatgtcagtatgtcttactactggtgatgttggccttgatcacttgattcaggtaatgtctgccagctttctccattggaaagttactatctttccttttgcatttaataaataccttgaaagagacactttgagactatgcaaaccctactttttctcaaactcacctgctaattttagcatctggcaatagaactctttgagtaattttgattttacctttccaggctagcttataaactggtctaatttcatgttaattttgatgttaattaattgccttggaacatggattagtcaattttttttgttataaaggaatacctgaggctgggtaatgtataaagaaaaaatgttaattttggattatggatcttcagactgtacacgaagtgtggtgctagcatctgcctctggtgagagctcaggaagcttacaatcagggcagaaagcaaagtggggagctggcatattacatggtaagagggagcaagagagagagtaaggaggtgtcaacttcttttaaacaagcagatctcatgtgatctcagagcgagagctcactcatcactgaggggatggcgctgagccattcatgagggatctgcctccatgatccaaatccctcccaccaggccccacctccaacgctggggattacctttcaatgtgagatttggaggggacaaacatgtgaactgtatcagagctttatatagtaagtgggcaaaataaatttatactccaaattcttattaggtggaatattggctttgatttctatcagataacttattttttttatacctagagactcagcagagaaaagcctcattgtcatctctcttgtccaatgggtagaatttattaattctttcacttcacttgcagccttttacagttctagctttatgcataggtttaatgtgtaggagttcccaattgctactctcctggactggaggtcttgtcgtttgtgccctggtgagtgttaaaaaatctaagctcttacctgctaaagggtttgatcccacttcctccccaccccaactacctctcatcctgctgccacctattagcttgttcatcttcctctctggctgtcagctacctcttcgcgttggtacctggggacatttctctctgttttcacaagctcagccaggagtgtgagttttaattgctgcctagtctaccattttgccatgcacaatctctctcccatgccataagactctctaaaattacactggggaaaatactgactagacacgttattattagggaatgtcactttattattaatacctatgctaaactggatttggctgtgatcgtataggcctagttaaaatcagttccactatttaaaaatcttaatcacgcttaggcttctctctttctatttttgaagcacatccattcttataaccttgaattttatgggacgctagaaaaaattattggcattttagaataaataaatcatataatgttgtgccaaaacagatagagtgtttcttatgtttctaaagagtggaaaaaggaccaactctttttctggggttttatatatacatatatatttatattgtgtttattttatttctttttccatgattatattcttgtggaaatgaggaaatcattaacagtgaaactactgtttcatccaaaatacagtgttctaatggtctgttttctaaatgaagcttctatgaataaaagcaaggccgctatatagccatttagttgctaacaaatgacctggttagtgccacccatgatttcttctttaattagattgcaaattttgtgtttaaaaatgggagcagtaagtaaatgctaatttgtagttcctcagagggagaattgtgatgtaaaaattaggatataaaatgagaggataccgcagggcaggagggtaatggcacttgggccaccatagggcaggccctgccaggctgcttttcattcaagtaaattttgcaactcaaagtactgggtatggaaggcgtgccacatagtacagtgtttaatcatgtaagtttattctttcttcattcaataaacatatattgtgcatgtgctctgtattgggtcccatggtggatgacagaggctcagaggtgaatgagctgccttttgggagtgccagcctcatctgtggccttggactgctggttctgtgctgccaatctgggtcactctcttcccacaccattttggaggggtctctcctttgctgtccagtttcttctgcctgctcctgaagacatgaactaaattatatttcttctcttaagatgttccttaccactgcagctcagagtaatccttgcctctttgaactcattttatttatggctggtgctacccagcatatctttttattcccacatgcatgttagttggagaatagatggatgaatgaatgaatgaatgaatgaatgaacgaacaaaggtggtgccttttgtttggattcaattttcactcacttaataggatcatattgacagggcattcctagacttattttgacctttcttgaaggatgattcattctaccacttactaataattatcataaaagctaacatttatatgcttgctgcttaccatgtgacaaatgttgcactaaatgctttctacatattaactcatttactcctcacagcaatcctacaaagtgggcactattattattcccattttgcagatgaggaaactaagaagcagagaggttaaggaatgtacccagaattacatattaagttgcagagctgggatttgcatcaggcagtctagcaatttcatcatgagttatgatttagaatcaaactagctaaggttgacaattcattctgcctctctaatgcttcaggttcatcatctgtgaaatgagaatcattcaatggcttactgggggcgttagatgaattaacatatgctaaacactaagccagcaaatatccatgacattagttccatccatttcttcttaccactggccacatggaacttacactctgggtctagaaagcatgtatgtgcccctggatggctcagcagctgtctccaccaactttgagatcttggctgtgattaaaatctttttccttgactctgccttttctggaagactgtcttttggaatgggggcagttggggtaggattaaaaaacactttctgagtaaataccccttcagttcttcttctcactattgtatgtatttttatatttatctattttgccttgtttcagaaatggatttaaggtaagctagaaagatgtagacagttctgtaggataaaatgaatatgcaaatgctaaaaataaaagaaaaaatataagtaagaaagaacaggggagccaggagtggggctggcatacagagtatatttacaggctctgaagttagaggcatttactagcagtcagccacaggcctggctctgagcttcctagaagtcagtgcaaaataggagaccatgatccgttcatggtgttcataaagtaactataagctgggtgtggtggctcatgcctgtagtctcagcactgtggcaggccaaggctggtggaccacttgagcccaggaatttctgaccaacctgggcaacatggtgaaaccccatctctactagaaatataaaaattagctggacatggtggtgcacacctgtggtccctgctactagggaggctgaggtgggaggatcacctgaacctggggaggtcgaggctgcagggagctgtgatcacaccactatactcttaagttggacaacagagtgagaccctgtctcaaaaaacaagcaaacaaacaaaaaacaaaacccaaaacacaaaaaacataaagcaacaataagccaagttgcttaggaaaagggatcctaatgcagagtgcaagaaagactttctccactggccactcacagaaaggactctctggtaggtgagtggtggtctcagtagcgtgccccaggatacccagggataaggtccaggtggctgtttctgacagtattccctagaagaaaataatatcattccatcagaatactgttcagtcaaattaattctgccagaggcatcatgtgccatagcccaggtgtccaactttctgaggtccagcttaacactggggtttgaagctgcctcatagcactggggtgtgaaggagaagaaagtgcaagaaggcaggacttaggagagtacatcaataatcaattgccagaattttgatgtgtaataaatgacctgaaaatatctgtcacgcaaaaaaacaaaaaaacaaaacagcaacaacaacaaaaaaaaccacacacacacacatttatttagcttacaggtccgtgggttggctgagggttcgttgatctgagctgggcccagctgggatggctctgttccatatgtctgtcattctccttcaaggagcagcgggctaacccaagtatgtcgttctcatggcgatggcagaagtgcagtcagagtgggaaacaagaagacctcttgaggcctaggcgcagaactggcacactttgacttccacgtcattctcttggccagaacaagtcctgtggctgaccccattgtcaaagagcaggaaaattgtgcccctttagagagtgcgacagcaaagcgacacaggaaagggcatagatagtgagagggaagtattgaaggcaatgatgcagtatcccacagagggaatggaaatgactttgagaaaagctcactgccccttgaggcacagaggcccctgcactggttgtatctgctgccaccatgcaggtttaattctctgctgcaggaggcttgggcatgaagtggctctggttgtggctagttaccattgcgacaaatgagctcagtacaaattggaccctgcgagtcaccattctgtaacctgggtagaactttgtgccagcgcctgctagagttgcacactccctccctaagctggaatatggctgggcccctgaagtggcagggaagttagggttataactgacaaccagctcccccattttgtttgatcttaattaattcgtgctcattttcccttatattttataagtagaaatgtgaaacacttactaggtgagcatatttactttattttttgatttagagccacctaagttttagagatgaagctatcagcatatggatttcttccattactttgaaaactgctatatttggtactgatgttctgtggttacatgctgggatccattacatagaatttaagcacagaatgtttaaaacaaggagccaagaacaagttctcattacattatctggattgaaaatgatttcttactgacattgtaaagtttcaaaattccagccactgtcaaaacgtagccgggtaacttgcctagatcgtgtctatgacttctaattcagatttgattctcagcccagtactaccctctcccaagctcagaattcttcatagaagacccaaaacaaataaaaaaaataagccacaacaataaaatgtaagaaattctcctacttcatattctgggaaggaagtaaatcattttattcattgatggacttatatttctgcctttttgatttatttcctggcatgagagacctagttgccttaatgactatttgtcaattgagcacaagcccaaaagtctaccctggggcttccatgtgagtcagtggtcccagggaagagccactgctaagggttgtgctggttgtgaactacacaactctggaacactgcatggagagcctctcttggaattcctttgtcagtggttggggtattggcacaaggctcccagcttttactctgcccctcatcctcttcttttcctaccaaacacctatcccaaatttggcttcttggtctctaaatcaaaagctggtctttcttcctccctcccaccctccttccctaaataaatgtgccctcttttcatagtgatttggcacatttatttagaatggatacaactaggtccctcctttccttgaccactctccctctgtctacacacacggacacatacacatgcatgccatctgtgacagagcctgtggaatttgtgaaccatagccacacaccaatgcccaggactgttctagagacctctttgtaaagttgcatgagcagagaaaaactaaaccacgcagtacaggagaatccatacagattctgaaaagttagttttattgtgtgaaaagttagtttttgtttgtttgttgtaggaaactagttacgttattgtaaatcaaaagtatctgagaaaggtctcaatcaatttagaaagtttattttgccagggttagggacatgcccatgacagagcctgaggaggtcccgagacatgtgcccaacgtagatcagggcacagcttggtttatgtattttagggggacttcagacttcaataaatatatgtaagatgtacattggtttggtccaggaaggtgggacaatttgaaggggtcgggggtggggcaggctttcgggtcataggtagatttaaagatgttctgattagcaatgggttgaaagagttattaccaatagaaaggattgtctgtgtcattataaggggttgtgaagaccaaggttttactatgcagatgaagcctccaggtaacaggcttcagagagaatagattgtacatgtttctaatggacttaaaaagtctgttctatcagtaattccacaagggaggagggtataatgaagcatgtctggctcccacttcccatcatggcttgaactagtttttcaggttaactttggaatgcccttggttgagaggaggggtccattcagatggttggggggccttagaattttcattatggtcacaacaaaatatatcagagtctcagcaggagcaagccattttgagaagcaagcagagaagaataaagaaagatgtgttagaacttacaaaacacattttctgaattaaaaattagaggcactaatagaaaactggacactgcagaaacttggtaataaaccagagaactatctttagaaataccaccaagagagcaaaattagagagggattgaaacaatgacaaagaagagagcagaaacgaaggtagagagagaactaaataaatgtagctaaagtgataatcaaagatcgtttaaaaaaatcattttctaagctaagtaaagtatttgtaaattgagagaattcactctgatccctgtaaaatatacgaaaagagatcattaaatataccttggtaaaaatgtgaaaggtcacatagaagactcttataagaatcaaagcaaacttatccaaaacaacgcttaaaaataccaccatcaccagcagaaccaatgccctaaaacccaaaaagatatgacctcaggcaatacacagaggcagtggttaaatcttcagtgctttgagggtaaacaagttgttttttatgcatggaacaatagaaatgttttttaaacctttaagaaaacaaaaaatatctagtttctttagtaaattgctcaaagtaatatattaccttaataacttaatccagaatatgatgaaaaaatcaaaattaagaactcaggaggacatcatatctttaaaaattggagcagcattggacattaaaacaggttttatacacacacacacacacacacacacacacacacacttacatatgtgaattcaaagtgaaaacattgtttcaaagaggtgaatgacatgattagaaaaattaaaaaggtagatgaaatgggttatgccacagataaaataaccgaaactcagaaagagagtataaggagactaagggcaaaattcctcatattttatctgaatgtgaaatcatatttcatccatttctttgataattaggtatatataggtttaagatattttagggcaatttcaagttaatcaagaataagattctaaatggaattgcagaacctaagagcaaaccaaatatggtaaatccttaatgctgtcaataggttctcagaaactgactttaggtgaatgacatataatgaaaccaattttcccttaggctaattgagataaacgaaagttaagttcctatagcatatttctgttcacaaaaaaatcaccaaacttctaaataaagacccaaacacttataatatcaagcattgaaataaatgggagttatacatacatttaagaaagatgaacagactgggtgcagtgactcatgcctgtaatcccagcatgttgggaggccgaagcaggtggatcacctaaggtcaggagttcgagaccagcctggccaacatggtgaaaccccatctctacgaaaaatacaaaaaattagctgggtgtggtggcgggcgcctgtaattccagctactcgggagactgaggcaggagaatcgcttaaacccgggaggcggaggttacagtgagctgagatcacaccattgcactccagcctgggcaacaagagtaaaactctgtctcaaaaaaaaaaattaataaaaacaagacaatgatttacccaattttggtgaatcagtgagtggcagtggccatggtagtgatgggttaaatcagggaataaatgtttgcagagcgaacattgtaaggagcatcttttcccaccttgcagttcaaaaccaaaaaatcacaagtagagcaggcttgctgagcgcttttgtcccatgtcctttattgtcatagacttgatgagtttttattttatcctaatttgtattcatttgttcattcattttccaatgtgcttattccagttcaaggtcatgggtggctggagcctgtcccagcagctcagggtacaaggtgggaaccagccctggacaggacaccatcccatcgcagggtgcactcacacatccacactcagtcacactgggaccatatagacatgccagctcacctcatgtgcacagctttgggatgtgagaagaaaccagagaaaacccacgcagacatggagagaaagtacaaacttcatgcagacagtggctccagcctggagccatttttttttccccatcaacattatcataaaatgatgttgaacgaggtgatgttattcaagaacctgctatatttaggatgtattgcaaaagacaagaagcaatcaatataaggtaatggtaacaatacatgaaaaactgaaaacacaaaataagatgacaggaggaaaaaaaatcaagagaaatcctcaccataaatgtgaactcttgattgcccttgaaccatcatgacacattccacctgctccagattggcatatggtcacctctcttttactttctcatttaattcccatttgccatattatcttgaattcctcttggagatttgtcagtatattcttgagacctgttctcttttcctttgcccttcattgtccaggaaccccagggatgcttattttgtctggagagggccagaccactgccaaacactgctgctgtggcttcttgttgtcaccaggctgctgtggaagacaggttctgccaggctggtggacactaccaggatgactttaccgggcagaaggtcatgggctgggttttgctgttgttttaagttgagagagacatgaacattctatatgctgaaaggaaaggaccaataaggtccaaaaggaaagggccaatagaaatcaaagtcacagatgacaaactggacaactgatggatcagtgagtagctgaggatgaagaagcagttaaggagggaatcaaggcctagttgtacctgtttccactctccacaatggatatttcagactttctcactcttaagctcctaacttcaccattttcctccaatttataacagaaaacctcatctccaggttaatagagcatatagagatcctgagatgtaaaccacacccatgcccccacatccacaacttgccattcctttttcatctcggtagaaaaggtgtccctcctgctgtccaaagctggcttccatgatggccctgtctccctaacactcaacaagaggcttagagtccatccgaggcccagcacattcaattctagtttatgcctctgagctgcaacctcagcccattctcttcatctcagatgcactcccgtgcctacctctgcattgcttcctgagtggtggggcttctaactctctgctcatattgctgtcttgctcaacacccttcaagagattccgttcaccaaaagaagaaaacctgggtatcctacatggcgtacacatgcatctctcatgagtgggccccgcctgccagctctctaatttatctcttgctttgttttcactatattctaatcattctatgaatcctgaacattgtggttcaattcttggctccaccacttactattaatagtactgtgcccttgggcaatctgttaaagctctctgggccttagttcctcatcagtaaaatgggaaccaagttcctactgaaaggattgtcatgagggttaaatgagtctatgtgtgtgaagcagatcaatgtttgacataccctgagctcttgataatgtctgtgcctgttattaacactttgtacagcttctcagatgtattataccatcttcttgccctctttttttttttttttttttttgagatagagtcttgcttcgttgtcgcccaggctggagtgcagtgacacaatctcagcttactgcaacctccgcctcccgggttcaagcaattctcctgcctcagcctccgaagtatctgggactacaggtgtgcaccatcatgcccggctaatttttttttatttttagtagagatggggtttcaccatgttggccaggctagtctcaaactcctgacctcaagtgatccacctgcctcagcatcccaaagtgctgggattacaggtgcgatccactgcacctggctcttcttgccctctttgaatctttgaggatatgattctttctcccattcctctcagcctccttcccttactcagctcccacttctctggttggcagattgcctttcatcttcaagatctgctctgctaccacctctgctgtgaagctttcctggatttctcgctatatgtatacacatgtcagactggatgaggggtactttctcggagcttttggacatatctttattgtagcactttttctgcttccttgacttggctttccctctagtctgtgattaattctaggatgtagatattgagggttgggggtcaaatctggtccattcctctattattctccatcatttgacataaagttaatatttaatcagtgtttattgaatgaatgaatgaatggattcatggacaagggatgtgtgcagacagaacacaatagaagaaatatttcttaacaaataaggggaagagatgttgaagtttattagtaatcaaattattattgattaaaatgagacatcatttttacttgttgaattaggaaacactttttatggccaggcgtggtggttcatgcctataatcccagctttggggaggctgaggcaggcagatggcttgagcccaggagtttgaaaccagcctgggcaaaacaaaaagccaaccccgtctctaccaaaaaaaaaaaaaattgctgggcgtggtggcacatacctcacatacctgcagtccccagatactcgggaggctgaggtgggaggatcacttgatcccaggaggcagaggttgcagtgagctgagattgcaccactccactccagcctgggtgacagagcgagactctgttaaagaaagaaaaaaaaaaaacacttttttttttcttttacttctgtctccatgtttgacaggaaacactttttgaaaggatattccattgctgtgggctcttactcattgctgatggaagggtaaaagcagcttagtactatgtgtcaagacctttttaagtgttagtttcttttaaatttttattttacttttcatttttgagacactttctcactctgtcacccaggctggagtgcagtggtactatcataactcactgaagcctcaaactcctggactcaagcgattctcctgcctctcagcctcccaagtagctgggactgcaggcacacaccacaatgtcgagctaatttttaaaaatgtctgtagagacggggtcttgctatgttgcctaagctggtcaaatgttcctttgttttgcctcactaattgtacttctggaacaccatccgaagggaataattgtaaatacagacaaatgtttatgcatatagatgctcattatggcattatttatataaaaatttggaaaaaaaatgtgtaatatctagtaacagaagtatggtttagcattttggtttcagaatagtctgtaataacatggaaatgtattagttaagtgaaaaagatgaaaatatgttcacacctattaagaaaaagacaaatgcccatgcatagtaaagagactgcagaggagtgtaccaggatgtttacttggttatatttcggtggcaggggtgtgtatggtttttcttttcttttttttccttgcttttgcatattatccaaaatctctataattggaaatgtattacttttataatggagtaaagcccatatatatatatatataccattttgttttcctttgagacatggtcttgttctgtcacccaggctggcatacagcagaacgatcatagctcactacaactttgacctccttggctcaaatgatcctcctacctcagcctcccgagtagctgggattacaggcatgtgctaccatgcctggttaattttttaacgttttggtagagatggagtctcattaggtttcccaggttggccttgaactcttggcttcaagtcaccctcccaccttggcctcccaagttgctagaattacaggcaagaaactctgtgcctggaccaaattttatattttaaagtgtgtgttcaaaaagatttaagaatctgattatattactgataattatttgatatgagtaagtcttgaattactaaattgattacaagcaccaatatggcacagactgtgttttgtattcaaccgttgtgtgatcaataagtacctgtgggtttatttggaggcacccttcatcatgtaaggccccctgattgtcacagagctcaccatggtcttgtaggcctctaaaccatcgggaaccaagtgagagacagttaaaaacaaaaagccaaacaggtgggatttgcttggagacaaataatccctgaacataaagtgggtgttaatgcaaaggcagtggtagaaaacgaagaactctgcttgtaaatgaaatgaatattcactccttctgcttaccttgcaagttaagcaccagtattgagacttcatttgctgttaccagttaccaaaaatgttgacacaatttaaaaaacaaaactaaaaaacccactgttgctttagcttgtttaaatgcatattgtaccaaatcatggaagaattatagatgaacattttaaaggatttctaaaattatacttctatgaagaatagactgttaatggtatacagcaattactcttaactgcatgaaaatatctcattttgtttggctacacttaaacaggcctgaagtctagtgcaccaagacatactgaatttcaaactaaataaattaaaattaccatgtacattccactacatgtcaaaacaggaaaaaccatagtattatagttgatatgaaatgaagattacatacaacagtaatacagagaaaacatgaagctgcttatatttatttggaataagacaacagggtcaatgattttcactgcagatgtacttctttttgagaaaatatatccaaaaatcaatttacaaggcagatgaatttggctgttattatttatagtatgtaaatattatttagtttcaaaaggatttctttaaaccaggcacagtggctcacacctgtaaccccagcactttgggaggccaaagtgagaggatcacttgagcctaggagaccaacctgggcaacatagcaagaccccatctctacaagaaagtttaaaaattagccaagcgtggtagtgcacacctgtggagctagctacttgggaggctaaggtgggaggatcgcttgagctcaggagttcgtggttgcagtgagccatgatcacaccactgcactccagcctgggtgcagagtgagaccctgcctcttaaaaaaaaaaagacttattatttatttcagggttcagtgtccttgcttgtcattaagaacttgacagaaattagaggaatttaaagctatgatgttagatgccactgccaatttaaaatgaccaagataaagatagcatatctttatatgtaatagagagtgaaagagggcatctaattcaatttctaaaaattaagtatttatggagcatttcagatctattcattgtataaaagaaggcacacctggagtttatttctttagcactttagacttactcctgaatatgactgtttaaaacaagcatgccattttcattttatatcctgcagatagattctaaggtttcagagtcatcaaaagcatttcacatttctccaaggtaaacttacttaagagaagtagtgctttcagtttaatacaacttgaaattatctccattgtgagatggtgaaaatagtaaaaattgctattatttattgagcattcatagttcaaggtactatgctgaatgctttttatatcttgctaacttaatcctcatttttcatttattcatcagactacttgttatagagagcttactatgtgccaggggctacttaaggtgtcacagattcaacaatgaacaaaatagacaaaaaccactactctctgtggatcttacactccagtgggggtgggagggagataaagactatcttcaaaataagtaattatataccgttagagtgtgatgaatgacactgaggaaaagaaagcaggaaaagggttaagaagtgccagagttgtagaggaaggggtcacactttttttttttttttttttttgagatggaattttgctcttattgcccaggctggagtgcaatggcgcaatctcagctcactgcaacctctgccttccaggttcaagcgattcttctgcctcagtctcccaagtagctgggactacaggcgtgcgccaccatgcccgactaatttttgtatttttagtagagacggggttttgccatgttggccaggctgatctcgaacccctgacctcaggtgatctgccggcctcagcctcccaaagtgctgggattacaagtgtgagccaccacgcccggccagaggtcacacttttaagaaggttggccagagaaggcctcacagagaagctgacatctaacaagataagatgccctacaggaggtgaaggaacagcctatgtgactgtcttggggaagaacattccattctaggtagagagaacagcaagtacaaaggctctgaagttgaaatgtgcctggcttgttttaggcaggtgtagagggaaagatgggaagggttgtagaggatgaattcctagcgacagcagaggaggggccagatcatgtcaggccttgtaagccatcatgaggcttttgagttctactttgagagagatggcaagccctcacagggttttgaacaggcaaagaacatgatctgacttctgttttaacatatcatcctggcttctataggaaaataaaattctatttcacaagtggtcttgtcccatttcacagataaggaactcagattcagagaagttgagtagtttaccacagttcccatttactggtgaattagtgggactagaattttaatacaagtcaatgtaatttgaaagctcacactttttccagactgcctcccaattgaaaacaagcttgtgacctcagctggagtagttttctgatagtctacagtgaccccttttttctccttttctgtggaattccttggtctctcttgtgaggccaccatgttgcataactccggaagaaaccacttataccacaagtctataactgtgccctctggaggtgggcagtatgaagccaaagtgaagtggccatctatggtggccttgttctccagtgaagttgaagagctttgtacatggcattaaactctagttaggcctgtagcaaaacctgtttggtcagacatttgtgtcggactctctgtgatgtattttgccatctctccttcctctgacacatattctaccagctatctctaccaccctctactgtctggcaatactctagctgcagattcaacaatgaacaaaaccacagtatgacatgctggaatataagtggcaatacggcaagggtttctgttttgtatgggcagcttaggcccacaagtgtaagagaaagcctgagggagggtaggatatgagcaggtgtgcacagcttctgattacaggaagcaaaacacattttatttgatgaatatcaaattgaaagtaatgagaaagggtgctacctaattgtcgccaaaactgctgcttggcttaatttaggctcaactagattttgttgtatgccttagggtctgaaggcttaggctcttgagcccttgtttatgctaaaactaatttttttttagtttatttgaaagacattgcttagactttaatgattcaacaagtaagaaaataccctgagattcagagctttaaaaggaaattttgattcaccattttactggatgactttaatggaattatgtcttataaagctgtttagcgtttcatgtttcagaattctgcgtagaattctcaataccctagagcatcttggcatttttttgagtcttatgactttagttactaaagtcaagagaaaatcatggcagcatcctttataagattaactaaataatactgtgatattatagtattatactgtataaaatattagtgccaggaatgtagtgcaatgttggctaaaggcaaaggtaacttgctatctaaatcttcaagattagtaataataatcacaggacacaagatcaatacaatcacaactgccttttaaaatacatttttatttccctgaaatgattggtcaagaagtactgagatcagattttgctatcagatcttatttcaagttcagtatgacattttaggtgaggaagggctatgcttgatggaagttgtacctatgtttttgtggctgctgctaagcaaaaatagagtgtgcagaaagcagtttggcagtgccacaataggttaaacagacttacctgtgactgaggagtttcactccttggtatatataccccaaagaattgaaaacaggtgtttacacaaaacttgtacacagattttcatagcagcactattcacaacagccaaaggtggaagtaacccacatgtccatgtatgtatgagtggataaacaaagtatggcacattcatataatgaacaatagtatgatagtacaatgaataagaattcagccgtgaaaaacgatgaagtcctgatacatgctactacatggatgaaccttgaaaatgtgctgagagaacccaatcacaaaagaatacatattacataattccatttatataaaatatccagaagctggcaaatctgtagagatagcagattctgggtagggaggagggttaggaaggagggaggaaagaggcgtggttgctcaatgggtatgagctttctttggggtgatggaaatgtttcagaactagatagaggtggtggttatacaacattgtgaatatactaaatgtcacaaatggcaaattttatgctatgtgtattttaccacaatgaaaaatggaatgtgtgacttttgatttttaattctttgtgaatcctactaaagtttaacagggcgggggtgagtcctgaaaaacacacttgtggcaaatgcggggcagagtggtgacagccatctgaggtctgcaaggtgaggcttgtacatcctgattgagatccctcgtgcaggaacctgcctcatgtgggcacagcagccacacaggcagccgctccaggagcccctgatgccctgcagggctgttggcagtttcaaatatagcacagcttctttgaaactttcatgtaaagtcatgtaaaaccggaatactgagctgtttaaaacccaagcatacagaaacccagcagatataaattttaactgcagtgaagccaggataatttcagtttatccaatgaaaaggaaaataaacttttatgttctggtggtgctataataagtttagtgaaaggtgtatggaaagtttctagttattgctccacatgttctttttccttgtccttgggagcatgccactttctcttcttcacgccatattctactctcaaaaggaaatgctttcgaatgtttttttttttcatttagacaatgaaaataatatttgattattacaaaaattcagaaaaaatggaaatacttttttttaaaagacatctcaaccattcaggataatactattgatgttttggcatgcatccttctggtcttatttctatgaccatatgtgcacctgtatcttgatttttcactgggatcatactacatttatcaacatagcatggacatctatcctaccaataaatatcaatcaataccatacttttctttttttagagatggggtctttgtctgtcactcatgctggagtgcagtggtatgatcatagctcactgcagcctcaaactcctaaacttcaagtgatcttcctgcctcagcttcccaagtagctgggattataggtgcatgccaccatgcccagctatttttttttttttttggtagagatgggttctcactatgttgccctgactggagtacagtggcatggtcatagctcactgcagcctcaaactgctgggctgaagcaatcctacctcagcctcccagacatcataacttcttttttttaacttttagatttattcttctataatcttcttttttatttttatttatttatttatttatttgagacagagtctcactctgtcacccaggctggagtgcagtggcatgatctcagctaccgcaacctctgcctgttgggttcaagtgattcctgtgcctcagcctcctgagtacctgggattacaggtgtgtgccaccatgcccagctaatttttgtatttttagtagagatagggtttcaccatgtgccaggctgatctcaactcctgacctcaggcgatctgcccatcttggcctccctaagtgccgggattacgagcgtgagccaccacgcctggccccaaacataatgcttttaatggtgatgtagtgttccattttacacacatggcatgactgtttcttgatcagcgttgtagaggagccaggggctttccttggagtggctcttttgtggttacttagccctctgtcagagatggttggtgactcaggttttctgaaattattttctcttactttttaaataatgattagtgatagccctcaaagcagagatgatggacaataaaggcaataaaggtccataaaaaatcagcttaaaccccactgcctttaggcacatttcctgactgagccccactccatcagttctctccgccttctgtgtcccaacagaagagggatagagtagtaggcaagagcatgagctttagagccagactacacgggttcacattctggcttttgtgacattaggcaggttatttaacatttctgtgcctcagttcacatctgtacagtggggataatagtagcaccacctcctaggctagatgccagaagtccctgctagcacaggacctggcacacagtactcaacaaatggcagaggttattgctattactcagtttatttaagtggccctaccagtttgtggctttgaaagatcatctatatgcttggacagtgcaaatagataacagattctgaaaagttcaaatgccagagagccttttacagtgttttccatatagcgagcctcctgccaatattactaattgattgtctgacctgacttgctgaaattctgggatcatcttggttggattttgcattcatttcccattaaaaatacaaaagcaaaaccaaatttaaacaaaacaaaacaacccaggaaacttgagaagtagatgtagattaaatgaatttcctttagataggtcaacatcaatgctgtgggctttcctagactctatggaaattcttgactaggagaatctagaattattagatgataatgtccagaaatacctaaaagaactgaaagcatttattctgaaagacctctttctagcagaaggccaaataaaattttctattcccttgtttattcaggattcttgggaactgaattatttccagtaaataaattttctagacagtggaagcttattcctgtaaccaccataacattttgcattttaatcattttgatataattctgtctggtgtatgctgcttagtttatggctttcatacagagttacattgaaaacaattcagccaatttgctaggccttgagtcgtcttcattgatatgttgttgtttagttttttttttttagctctgcctaataatctcagtaccatttgccttctaaagatgcagacagctgtacgcttacataggtcttttaacttttcatttttttttctcttgtttttttttctcactgccagggtgtgtccagttttactttttattacagaaatgtgcatgattgctttccccatcccaaaacacctttctaatttattaacttacaaattttatgtcccaggaaaccagaaacccaagcctgttactattttgtgtaaggaagattaataggcattgaataaagtcatgtacttagtaataggttttttgaccattcaaagcctttaaaaatttacttcctggttgcaggctgttatttggtaggtgtttaactctgggcaaaatgccattttatttataagctacagtgcctatgattttccattctggcattggtgccttcctgctgctcccaaattaagaagagaaattaagttaaaaaaatcacatgacctctgtacagttggtaaaagttttgtaaaatggaatttggatcttttaaatagaaggagatgtaaaatactgtattcttagatatcagtttataaatgtttttccatttttattacagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaagtaagcttttgttttattgattctaatcatttacatttctgtgaacctgagtaatgaaggaatttctattttatcaaaaagtgcaaaaagaaaatagacatgtgtcatcatactcatactctactatttagcacaaacaccttaaatcattttcggagaagtatttaggtacagatatttcccagtgatggagagcttgtgtgtgtgtgtgtgtgtgtgtgtgtgtgtgtgtgtgtgatatggcatctggccctgtcgcccaggctagagtgcagtggcgcaacctcggctcactgcaacctccacctcccaggttcaagagagtctcctgcctcagcctcctgagtagttgggactacaggctcgcaccaccgcacccagctaattttttttttttttgtatttttagtagagacagggtttcaccatgttggccaggctagtcttgttgacggaataggggaggccctgtatctttgaaagaataggcttctcccttgcatgttcttttcatttgtttctagaagctttcaactgaagcatagtaaatcaaaatgttaggagggttaattctgagatgtcgtctttttacattattttagtactgatggggatttataaatgtaacttttataataaatagaaaatggaattttcaagcaaacattctgtagaatttctttgaaattatttcttcttgaaaataatgaagttcagtataagctatttcttatacattgattgtgtgcgtgttgagcttcattaagtcattgttacatacaactggatgcaaacaacttaatgtgttttttttgcattcatcttacagaccttatacagtggggagaaatataaatttactgatttcatctggaattagaaaaatcttagttcttgctctagcttctaatccgtattgctgcacaccactgccatctctcttccttgtgacttcttgccttatccccaaacttgaagtctgaacccaagtggccaactgcattccctgaatatctgtgtaggtcccatagtttgtcttagaaataatcattttttttattaatccataatgcatcctctttgagtttttataaagatggtatttttccttgactctttaagctttcccaagcttcctagaagatgtgtggcctgagttttgcatggccctggccctgccttccaccctggtgttgcccccttccccagagtgagaagtgtggccctccttcattcaaggaacacttcttaggaacaatggggctgcttgaccagatagcctgaggttcttccagatccatcaagctttgattctagatataaacattctcattgcaaagaaaagagccaactttctttcctgttggttctaattttgcccgatgcctggaaaagtgttggctgaatgagaacattggacaagaatgtctttgcccccataagactggagaaaatgacttttgggctgctctagagaaaactgctagcatctgaaaaaattgaagtgaatattgaggccccagctggggcttccaggtgataaggtttgggtccaaggaaaagaacagaaaaacaccctcaagtcatatcatacttgtgttggaggctctagatgcctgtcaaattaagagatgttttcaaatatcagaaccatttttgactagtggtcaagaatgcagatcaattacttagagcaacacttgtggctgtagccttaataggctgtactgtcaccaaccaagaatctgcatcttgaaggaaaagcctttgtaaggatggagtctggtggcctctgaaatagaaaaagttgatgaaatgaaatgtgactgttcttccttattgtgaattccaataccaattttcatacttccatgtgtacattctcaggaaacatcacaaatgtattttctttcctatagtatgtaattattactaaaggtatacaaggtatataaaagctcatttacgttgttttaatgcagaaaaaatgtattacccaccaaagacattaaaaggctgtgcaaatcctccagattacctttgagtgatgatcttctagaatccttattgtcaaggtaagttagagttccactcttgatagggattgtcctgcatagttttatttgggggaccattcctggttttacatctccctttaattacccttgatttacccttaactgttttgattatattattggtgacctgcctccatttaagtgttacagaaggaaaagtttgtcttgattttgaatgttagagagcctattacaaattattattttatctttttaacatgaatacacacttatagatccacagattcctgggacaaaatgaaatacacaactttgttggttaggaggacattagatgtaaaattcagggcaggtttttcaaagcagcagttcctgatagctatagacatgcagtaagagaacctagggttattagcatggggctctgtcctgatagagcaccagatgtaaaacatagagattatgatgctataaaatgagagcatggtgaactgctttctaaaacacatcagttctcctgttgaacctgacttttgatttcctggcatgtccctctcagccacctagactctggccatctcttatgcttcctatagcatcactcactctagctcctcctctgacttatatatcttgataattctgacattttcagctgtgttctaggcattgtgatcattgttttggatatattatctcatttactttttgagaacagcttggtgaggtcgaaactgttatccttcttatctcatacgtaaggatgctgaggtttagagagatgaggtattttgcccaaagtcacatagtgtagaagaagaagagctctgatttgaatcctgaacttttcaaatgcacatcctctgcttctaatcattttgagttactgtctacaaatagccagtagattaggatgtcttgacagttctacctcctccttactgcttgcttctactctctcctctccatttccactatcatcattcttgttctgacccacattgcttcttaaatactgcggtgccaccacattggtctttcatccaccagtgtctaaatgtttaaatccatctttacatatagcagctaagtaccttctaagagcaaaaatgtatgtcatcttattgcacttttactcacaaaccttctgtggtgtctctttgctctctaaggaaggaccagctctttaactttgaattaagctccttctccatagtggggcttagggttcgcagctggagcattgttctcaaatagggtctgaagtagggagtccttgtttgagacaaaaggagaaaccaaaggaacagataaagccaaattctatgtcagggaactagggtccaaggtatcaggagggaaacccagaagagggcaaatctagttggatgtgtatgtgcattgaatcaacctggaataattttctagattatcagttctatttgttttgttttgattttgtttttgtttaactctatttgcttttatttgctagcagccgtgtgagggatcctgccgtgaaggaactgagatgaagtaggcaggccttggactcagagttcttcacagatatcatcccccactcccaaaactccccttcctgttcccagtagtccagccacatgggccgtttagcatattacacatatacctcctgccttccccctcccccccccttttttttttggccttttcccttgctatttcatcagtaggcaatagctcccaatggttttcacttgctgaaagcttgctcttccttcaagacccatttcaagtggcaccatatccatgaagctctgttgcattcgtttggctgataatcagagtgattatctcctgctcagaattctcacagtgctatttatgtgtctctttatcccttaccttggaatgaagagttgtgacttgaacttcgattcattcagatgcagacactgcttctgtgtgatttaccacctataaataaccaatgggttgtcacatcctgacaattttacccccctcctccactcccatctcttaaattctttgagtccacttattagctgtgtgatcttgtgcaagggttttgacctgcctgaacctcagattccttatctctcgaatgacgtaacagtacctatttcctagtggttcagaggattaattgagataacatacataaagtacccagcacagtacctggtgcaaagaattgattgaggactaggagagaaatttaagtcagggaccatagaccacacactcagacttagaaatgaactggaagaaacctgtgtctttctatgtagaggaagccatgtttttcaacaattggatctgaatgcctttcacacattaagctgtcttctagtcaggaagctgtggatgtttattagattatcttttgatggtcttaaggatgagttgtcctggaaagtccagtaatgtgggagcctggcctctggaggacctacatgtttcttatccagtgctgaggccaccaagtcatcatcctctcattctctcagcagactgttttgtctttgcctttacgatttgacattaaatgcaaaaagattgtttcagaacttgcttcgaagtcatctcagtctctgaacacatctgtctccaagcccagcttagctttgaggaggtcatcccgctcagctgctaagcagaccatgttcagtctaactttgcctctaattgtgcagtgacccttctccacactcaggggaaacttcagactaatcagattagaaaatgtctcattcccattcccctctccctccaatatgccctgccatgatttgggtcacatgcttagtgttttgcatcatctctgcagattcctttcaaagactgccctaattcctaatgggcccatcagcctgcagcttacatttatattctgcattcttattgttccccacagactccacagggctttacagagccctgaccagagtctctttctgcacagccctccttatggcacgctaagccagagccccctctgacgtctacagtctcccgtgggaggcaggcatggagcttgttgattttgttcaatgcatgctcttgcccaggaatagttttacctgccttggaatggagctgggcagctgctgagcagccgtgtaaccctgctgtgtaaattcagatcaggagatgaaaaacaatatggctaaagggttggatgctttctttcacccagtaattgttacccatgtatttctcctaaccctatattttggtaccaggattttccttctactccattcccatttttcttataattcagcttgatcttttccttattatgttaacataactcaaactggaatcaggacttcaaaacctttttgtacctggttacctcagcccctgtcagtttgtgctgtgggagctggtataaggtcaccttacttaccaagcaaattcatttcattaatgcacagagcatcagacttaaatgttctatatagtggtagcgattatccattaataataggagtgatactttgtattgatgtagtgctaagggccttagaatattttgtaaatttttgagcatattaaaaggtacattttaattggcagtaggcattattcctcatttcataagtataaactctgagagtctctcactgaaagactgtgctccaggccaagatgagcctctaatggaagtagaactacaactgcctaagatactctaaacctttgcctctatctgagctcctgagggtagggactagatctcgttcatttttgcagcctcaaagacttgtcctgtgctaacgcactggacatggggtagaaaaacatgggctcggtgtccaccagagctgctcctgcctctgcaggtcaactctactgtttcctgaccatgcgattcttgggcatttactcaacccctctgagccttcatttggatattcatattcctctgtaataataagcaaaaaattctgattgttagaccataagaggtagagggaattctgaagccattccattctgtattcttcatgggactgggaaggaaagaggcagccttctcccctaattgtggccttctgaatctagacttggaataactagagattcaagtgcaactctttccccagcagctctgtcctgagctagacttttatagttggctttgggttccatggaatgccttagaactggcctcccaagagagctggtgcctcatccagaaatatcagttaaaatggaaaaagttaacagggctttaaaatcatctcattatagtctacccagccttgccccctgccctgctcccagaggcacggttagtgctcctgtgatttcacccaacaatacctggcagtgaggctgaagggcaagggctgagccatgtggtagttattgtggcagagtgtttggtgtactgatgaagttttcacagagaagccccttctctctgtctctctgtctctccctttttcctcctttgtgtgctctctcctctcactctctctgtctctttgtcagacccatccacccacccagatgctttctaccttttcaaatataaggggatttctagttgaaaagatttttcttttaaatcccaaaccatatggacaaacagagtatcgactctatgtacaggccttacctggcagctgtgacccacctcaccagagatctgtgctggagtcagaattggaatttagaggcatgactatttagagataaccagaattacttgttggcaacttgacgcagaggcccagagctccatctcttctcaagtgtctggccttgacgacttttaccaggtgtttcaagatgcacccctgggttcgttgggtaatggactgaaaccaaatacaactgagtcaaaaatggatcttcaccgtcttctctcccttccagaccattcccctaaatgatgaggtgacctttgcaatagaggagaagaaggctcctcttcagcaaaatacagctgccactgagccttttacctctatcaagggtggaaatagagcagttcaggattattccccgtagcaagaagatggatggcttcttggcttctgtggttttcaagccatttatcattttggggagggggagtatgaacatcagtcaaacatcacatcagactcagttctaagaactcccacctagcatgacatcaggaagcatgttcgaggggtcgtattatctagaaaggaaccagaggaattgccttccctccccctttttccacaacatgtctctgagtttgtgtagtggagaaaatggtggattcgcaagtatcagagggaaagaagaatttatggaggttttaggaaaacactttcgcactgtgagctaggacttgaaagtaagaaggctgactttttaacaagcgtagaaacacttaaaagccagaattagtgctgccctttagggcagtcaccctggaaggctgcacactgattccaacaatgtggccatagaaagttcttctttggaattgcttttcaaagccttttgaaaagaatttcctccagagtggcaaatctttgtcctttgaccatggatcagagttttaacaagagccaatgtcgtttggagaggagtgaagcaggggactcaggtggagaattgggaccactttttttttttttatggaaagcacagcatggccatgaaataaggagatttatcttctatatgattcataggcttttccagattattttgaaaggatggctaggatttggtaaatgatgcttctagccatgagacagagggaggcctctgtgatgggggacttggggagataaccttcaggggtaactctagtcactgactgattgatttgttctcactcctgtaatattcagacctttgtctctgaactgcttcccctgcctcctcctcctcctctgacctatactattgttaggactggagatcttccttatgtcctgattctctccttacaacctcatctaacaagcatggtgtatagagtgcatgttataataacaaatgatggcatgaaaaatcaccctatgtcagtggcccaggaagctacgggcagaattttggagcagggaggaaaactgagagactcattcctcctgaatatactcctgactagtagcacttctttctttccacatctgacttttacatgtttactacctggaaaatcatgtctcagagtctctcatctgctttttacactccttaaaattttcttcatatcaaactgacatatgttgatagtcaaaaattatcaaatcattctaaaaagcttatttcaacaacagcagtctctggccacattcttctccaccccccagacccattcacaagaagaagccactttcagcacttctagctgcttctgctatttaaaatagcatgtacatattgagtgcactgcacatgatatcataattgatcatttgcagatactgtctgctaacttcctgttatagtgactgaaaatttagcttaatattgatttacattgctatttattcttttggaatgctcttaggatcttctctttattcctagtattctggaagttcatgatgagagagagagagagagtgtgtatgtgtgtgtgtgtgtgtgtgtgtatgtgtagctatatatagattcattgtgcttaacaccctataggcttttctagtttggagtcactgtcctttggttctgagaaactttctattaattatttaataatttcttctctattatgagaactcctattgctaagattttaaggccaggtgtggtggctcacacctgtaatcccagcactttgggaggccgaggcaggagacttgagctcaggagttctcggccagcctggcaacatagtgagaccctgtctctacaaaaaataaaaataaaaaattagccaggcatggtggtacgcacctgtagtcgcagttacccagtaggctgaagctggaggatcacttgagcctgggagatcgaggctacagtaagctataattgcaccactgcactccagcctgggcaacagagcaagaccctgtatgaaaaataaataaataaataataaatagaaagattttagagctctcgaatttggatattttctctcccagattttgttttttattaggatgcatttactaagggatttccttaagtttatattccagcccttctactgcatcttttactatcatattaaaaattttaattccaagagcacgtttttcatccagatattcctttcttgtagtcttctgttcttttttcaggaatgtaatacatcctcatatctcacatctttccctgtgttccctgaattgcctttggttccttttgttttttgtttttttttgtgttgctgttttggcttctgtctttaatgttggatgctttggtcaggggaaggggtttgttgattagtggatttcactacccagtcaactcctgagccttcattttattagagaatccccagaagctggaatctggagatttctctggaaccattcagagtgtggagagaagaatcctatcttctcctgcaaagataggagggaggttgtgatggggaaagggagagtttacgcatggccactggtattctaggaatagaaaaggggaaggaaggcacctgaccgcccctcacctctgcactccattttgcctcctctccccaaactggagcttctttcattgaatttctctggagaacaagcctctggtctctacagggaggagcacagtacggaggaagatacttggctgttcagttgctcttgctttcttttttttttttttcttttgagacggagtctcgctctgtcgcccaggccggagtgtagtggcgcaatctcggctcactgcaagctccgcctcccgggttcacgccattctcctgcctcagcctcctgagtagctgggactacaggtgcccaccaacacgcccagctaattttttgtatttttagtagagacggggtttcactgtgttagccaggatggtctcgatctcctgacctcgtgatccgcccacctcggcctcccaaaatgctgggattacaggcgtgagccaccacgcccggacaccgctttctaaaggctttcaaacaatccgtgttttcagtgccacaccatattcctgcctttattggcacctggagtctgcagtcacttagtctcccaggaattttgtgggccaaatcgactggactctgagtgccctctccccactgacagggacatttagggttcagcttctcttcctcagctctgccaagttagttaccaatcctctgtttacttttcatcttgaaaagagtttgacgtctcttctctaccgtggtcttttttccaattctctttgtcattgtgggttataacctatttttattgttttttggtcattttggtaggattttggggaaaagggagagaaatacttgtgattgattcatcgtgatttactgcaaccctatctacttcccaagagcaaagaattcttccaagaaacatgagctagttttattccttttaattgaaatatcctttgttcttttctcccttgtgcctcttggggggattcccacacacactgagatcctctaagacagaactgaaaaggaaaacttggagtattttaccacattaccacaactcttcctttaggcctggctctgggattttggaaagatgaactcgttcaagcattttttctcaaaaaacttttagacattatttctgagctatgtatacttttattcagtggaccttcctgaatatcatttgattcctaaatattcttcttaaatgtccccctaaatggataaatggttcaatgttttgagtctgacatatgaactgggcaggaaggaagactgggtgttatgaggtaacaagtaaatatcagagttagtggtaacaacatttaatgataggacttcgtgtggtgacttccagaaattttccagtaagttccagagccatcatctagggcaaatgcaaattcaggcatagggactcagataagaggaacttcaggaggactttctaaggaagcaacatttgaaatgggactttccagacaaagggaccagaagtgcaaatgccttgcatttctgccagcaatcttggcatgatcaaggaaccagaagaaggttagtatacctgaaacattgtaaacagagagagttttcaagtgaggagatgtaatcagagaggccatcagcagccagattaagttgggtcttataaaccctgataaggagtttagcttgtgttctaagtggattgggaagccactggaggattgcaggcaagaaagtgattgatctgatctgtgttttagaaagagcactgtggtggaggatggtctgctgctaggtaagagtagaagtagcaagaccaagacaggaagttattgctataatccagatgagagacaatagtggcttggaattagggagtggtaaaagagatggagagaaatagatagacttgttatatgctacagtggtagaacccacaggactgcttagtggattgtatatgaggagtgaagtctgatgtgatcctagatttatttggtagtctttgactggttcccagattaccaggatactatacttctgaaacccctaggattgagtaagtgcctcttataattgatgtaatgggaatttactgacaaattctgtactttaagaacagatagagaaacttattttattgatgatctcctcaagtctcccaattttttggctttaaataccttccatatggctaatgactcccacatttatatcttcaaatggactacttccttgagcttcagactcatagccccacttgctcactttccatccaaatgtggcatatctaaaactgagctcatgatctttccaaccagcagcccctacagtctttctcatctcagttagggcagctccattgctccagttattcaagcaaaggcattggagtcatcctgaatactctctttttccctctctctcttacataatatatatagtcttttaggaatcctacattcaaaatatattcagaattggccactcctcactgccttccagtgccaccaccctcatctaaactgccgttatctctcatctggatccctgcaagggacttctaactgtccttgccacttctgccttgccctctgtgttctactctgaatgtatcagtcagagtgatcttttaaaaatatcataagtcccttcttagtctgttcagattgctataacaataccgtaaactaggtggcttataaacaacagaaattcattgctcagagttctcatggctgggatgtccaagaccaagatgacaacagatttgggtctgctgagggcccacttcctggctcacagatgatgccttctctctgaatccttacaggattacatggcagaaggggcaagagtgctctctggggtctctttaattaatataagggcactaatgtcatcatgagggcagagccctcactatctaatcacctttcctaaagccccaactcctaatatcatcacattgatgaggcctcaatatatgaattttgaggggacacaaacattcagaacattgaaggtctcataacctttctgtataatatgccctagtgactcttagttttcctcagcataaaagccaaaggtcctacatgatctcattctttgaccttagctcctactcaggatattaggaaatactttctttcaaggctctgtgctaaaaaaaagtttattatgagacatctttaattgagttttcattcttcccccaaaacatacacaaataaaagaaataatggtcctacattttggctataaatatttccataaacagagtatgtcctttaaaggagttgaaatgactagtgagccataatttaaagggtggtaaacagtgggtagggggcagcatattggaattgtatcttagaatccttggccaaagaaaatgtacacaaaagaattacagaattcccctttcccctcttctggtcactttgtttattccattttgtctagattgatgaggctatgtgacttcagcttgtaacatttaatttattgctgctaatttttattagtttataaatataagctattaattttttagtactttgagaagaaaagagaaaaatctttggactgattaggagtatattttaagggcaggatcctggaatagggtgcctggaacaatgtctagtgaccactttgtattttccttcaaaaactggtgttacatgataattagccttaaaaactggcagaatgtgatcaaatttaggataggtggcattgaggcattacactaagtaattttgtgtttaggtcattgtagcaattgtgttgaaattactgtatcttcatggccaaatctctattatggttaaggaagaattttatctaatatccataattaggaaatagtggtcaaagagattcattattttgacctatatttttctggtacagaataatcatttgttaatttttgttcaaaatgaaaatgagctgaagtttttctgattataaacttaaaacaattcagatgatacacaaaagtctaaagaaaaatcaaaaatcagaatctctcttcccagagatatctattcttaatatgtaagtctattgctaccatattttttctgttttttaatatataaacctaaagtgggattgtaactctacatactgttttacagcctcctttctacttaaccgtgtatcaagaacatatttatacgatagcaaatttggatctaaataaccccttttaatggctacataataaatgataaagatgccttttattttttcaaaacatatactggtagaaaaatgaatctagcttgccttaaagatttaaaaggtatgcaattgaagaaatataaggacattctattttgctgacatgtaatatcaaccattaaactaaaaggacctttaaatctttttaacaaaatttcactatagtcttcattactgaatgagcaaatttgcgtctgtggcaactacaacaagtatttattgaacacctactaagtgccagcactgatcttgttggggatattttgatgaattagataggcaagatccccgctcaaagaatttacattctggagggtcagaagcaataagaaattgtaagaaataagaaaactatcagatattgaagcatatatggtattatgttttcatgataaaattgaaactgacattttggtcttgaattctgcagattgagtcaaattatatattataattatattttcaggtttgaagacagtgaaaaacaaatagattataagtcatttttctctgccctgaactggagaaagaatccagtgcctgaattgcaaccagcatcataccttaaagaggtaaaatgaatacctattttaaaaaccatctatggttacttcccttgcatgtttaatatcctttatctttaaattatttttcattataaaatattaacatcagtgcttttggaaagagtgcttatgtgtttctgggcatttgtgttaaaggttaatttactttccatgctgagcaaacatctgctctgtaaaagcatgacttttcttatgcagctgaattttttttaacctcgatcgcatccaattatatggaaaataggataataggttacagttataaatagatataaacactgttatcaagggattctggtaacatcatcataagccacaagagcaaatctcaaatggtgcctatggcaagaatccctagggtatccgggtatccgcggctgtgcacacaggtttgccatgggtgaaacaatagagaatggggatgcacatttcacagtgaaaccaaatttaaaatcaaaattctgtagaaaaatgcttggttagggaaaacaaagttcacatgatcagatggtgctctcaacattgtggaattgtctgaattctctaagatctctttggactaattgtctttaagaagtgggtgggtgggtggtggtttgtttgtattttaacatgctccagaaattgattttcttgggaaagtcccttgataaagcaaatgtcatgtggttgatactcccagaaaggaggcatttatttctcctggtctctgctgaccagctcattctggctggagctggtctagtgcctctgggagttccctcaggcatgcagctactccaagggcagccatagaacttccagatggttgggggaaagtagtagcctttggagtcagacagagctgggtttgaattttggccctgccacctacttagctgaatgactttgggtcagttaagttacttatcttgttgatttatgaatgtaatccccagataaatcaggattaagtattgactctcatcaggttctctgctgtaggctggggtccagagacaaacattgtcactgctacctttgaggggcccactactgatgggggaattggtacgttcgtgatttggagtgtggcatgatacagcctgcatgggattctatgggatgaggtggtagctgcttctaaacagactgggggggaacaggaagtattttcaggggaggtgacatttgaaatttcaatgatgagtagtaagagttagcaaggtaggaaagtgacatggtctggaaaaggcatttccaacagaattctctggacatgggacagcatggcacttgtacagaaccaggaggaattggtgtggccagagcgaaggcacatggggaagaggtgaaaaggatgaagctggagatacctgtaagggtgacatttgaatattgtcctgcgaggtctggagaccactgactaacttcaaggaagacagcaacatgatcaagagtgccctttacagggaacttgctttggctggatggtgggtagactggagatggagtctcactctgtcgcccaggctggagtgcagtgatatgatctcagctcaccacaacctccacctcccaggttcaagcgattctcctgcctcagcctcccgaatagctgggattacaggtgtgtgccaccacatccagctaatttttgtattgttagtagagacaaggtttcaccatgttggccaggctggtctcgaactcccggcctcaagtgatctgcctgccttgacctcccaaagtgctgggattacagacacgagccaccacgcctggccatggaggctcttgtcctgttgtccccatacataacagcaaacaaagcatttactgtgtgccaactactgttctaagatctcaaaatcacctagcttatttaatcctcttagcaatcataggtgcatttattattcccagtttagagatgaggaagttagggaaacagcaatgtaaggcagagtcagaattttaactcaggtctcttgctgcaaagaatacaaaagaaaactgtcctttaaatataattatttttgaagacaatggattggattaacccaaatctgaaacactatcacaaaaacaaatcaatactgtcatttgccctgataaccctttcattctcatccatgtgaatatttaatttttacatacaaatagaaacatggtagatgggatttacattcttctacctttttgttgaatgttctagtagtctatattgactgtgtccctgtgtccctttagcactgctctccagagccctctaccgtgctctgaccctgcccaggccagtccttggcagctgacctttgtaggcacatcagtgggtcccctaggcctccagttgggttgaccagtgggatgcaccagcaggagagtagagggtgaaaggagagagaaatcttcttcctccctgccagtcacagcagattgacggcctcctccttccaaagtccacagcacttgtctagaggctctttgcatatggctggtcactccaggcgctggtaaccaccctcatgtgccccttcagcctcaggtggtagtaatggctccctgctgttataaacccaggggactagcccctattggtttttctaaacacttcccacaactttgtaactagtcactttattaaactcttctcgatttccacagtttgtatatgtctgccatttcccatgagcccctgaataatatacaggacatacctatttttgctataagcctttgtcattgttttccttactttctacttctctctttcctcttccattccactcaatccaccacccaaatgtttacctctgtgttgggggttttatcatttcctcatgtattgtatgaaaataagatcataccacatgcatttatctggagtgtgctcttctttcttaatcgtggaaaatttccctagtttaatatgtatagacctaagccattcttaatagctgtggtatgaatatataataatttattaatctcttttttttttttgagacgaagtctcactctgttgcccaagctggtgtgcagtggtgtgatctcggctcactgcaaactccatctcccaggttcaagtgattctcctgcctcagcttcctgagtagctgggactataggcacacgccaccatgcctgactaatttttttgtatttttaatagagacaggttttcaccatgttggccacgctggtcttgaactcctgactttgtgatccgcctgcctcggcctcccaaagtgctgggagtacgggcatgagccaccgtgcctggccctattaatctgctctttattgacaggcattcaggttgtttttacatattttgcctctgaaaacatattttactactttaatttttattttcctgatgactattgagtttgaatgagatcctgtcatctttttgtactacaacctacagtaagaaagattttttttcataacaacacagtatgcagatatataatggaacaaaaatttcacggattaatattgttctgactacatgtggtgcagtatgatacattttcttttttcatttctctcttcctttcttttcttttcctttttctcattccccaccacctctttttctcctctcttttgaatgttgttcgtgacccattaaattgatttcatgacccacaaaaagatcaccatccacactagaagagaagtcactgcatgggaaggccaaagatccactctgcctttaatcacccctccccagtttcatcacttcaactctgtcaactgggacaggtatcgagctgtggacctcagatgcttttgagaggcaatgtggaacagaaggtctccaatcacagggaccctagttcaaatccttagctctacgatcaactaactgggtgactttttacaaagcactcaacctttcaggttttcccatctcaaaaatggtgataagaatagttcttccattagggttgtgaggattaaggaagtcaatatacacaagtcacttaccacaatacctctcccatagtaagggcttaagtgttagatgctattattttctgtaaaattgagatgtcttactttcctcaagtcagggggctgggcagtccctgccaaggttaagatgggagattctattctttaatggcaagagaatggttctaggccaggaatgtcacatcagaaacagctgtgcttcagcactaggttcttctaattgcgattcatttacggtgagaaatttactcatagggcctcatcatttctgctgataaagcctagaaatatttcagtctgcaggaggcattcagaaaggactattctttttcagccaattaaaaagaaaagaaaatagatataaaatggtacctgatcaatttcaccaataatgagaatttaactagattccaaagagttcgaagcactctggtactgataagcttgttattatttcataaagaagacataaaataccttgggaatgttaccagtgagtctgtaatctcatgtgaaaatatttagcatgaaggggttgagcacaatgttgaatagtttatacagtagaatacaggagcaaaaagtataatatctactgacccatgtaagtgtgctcaaatgttattaataatgttgaataatgccctgaaacactgctgggtcagagtttgtcacaggtggggttctccaggaagcagatggagtctaatgtgcaggatgtttttttgggagtgtccttgggatcaactcccatggaaggtgggggaaaaaaagaagaatgggcagagggagaagtcgaactgtgatggaagcccaaagatatccttggccaacccatagggagctctggagttagcatgtcttttcagcgttgtcctgagttgggccagaatggcctggcctttgtcctggtgggttggttcaagaagagatatgactttgtgcagcgtggctctttgtagccaagacatgtttgtagctcaggaaatccaggaaggggactcccagcagctgggccaccaaatccctcctcaaggggattctgggtagtatatcacagcttggcaaccaactactcttgaagcccctgttgactgttcttggtatcaactgagagcctagcagtgtgacagcctcctccccagcttgttccttggttatttcctgatcttctattcatggtagggaactgagaggagagtggttatgccataagaggccatggtggagtcagaccagatgtgtaggtcccgggggtgcaactgggcagagaaaacctcccagttatgactttggggattgccaacgtttggggagtcttccatagccagccagtcacatgtagggcttcagggtaagatccatcaggttgtgaaggcaccccagccctgagtgtgaagtgatgagaccagaggtcttttgagaagaaggaatggcaggctgagctcccgtgtggaagcaaagcttagatggaggccccagggttgggaagctgcacccttcctccagtatatgagccggacaggctggcttgggttaaagtttcagaggtgttatgaagagctctgtagaagttaccaggacaggccaccacctggaacgtggatatttttactcctgggctgcatattgtcatcagcaggatctcatttctgcactgggaatcttccttagaaataaaaaaaacttattggctgatgaaagctgagtaggcttcagtactagattcaactctaattctgtctgcatcagcgtgaatggataggatggatgttatgggtggaaatttgggacaccttcccagtctagtgtgactaaccatcatggggtgagaagggagaggtcagaaaccaggaacaagaccacaggcttcagccaaccacaggctgagtaggggtgtggtctggtccacaagacttgagattggaagggagttctagcagggcatccctccaaaacagtgagcatagtgatggggaatcttgaagttagcaccattcggcaatcagagggagccactcagcaggctcagaccaagctttcaccctgccaaggggacagagctggctaagcccctatacccgtgaggttatagctggaaatacacagcatactcaaagggatcctggagatggatttgataaagggactgttgacggggtgggtagggttaagggaaccaagcggggcggggaggggggtggagcactcagggactggcaataacgggagaagcagggagggactgggggactggtgttattggagcccagcagaggagctggaactatagcagcaggtagagtagtgtagccactatagccactcccaaaccatggcctggcagggagggaacaggatgaagggaagtgaaatccatactctgacctcttgcttctcctgttttctgatctcctgatgctgcttcacattggctgaacccacccagaagccagagagcaaggaagcttgaggagtgatgcaatccacagagtcagtctcccagggcagaaagcagagtgaaaagggcaaagaatggatcttgaggggcaaatggagactgacccagcacaatctatttgttaccagaataaagccttgagctcagaacaagccccacagccaggataaaagctaggtctacactaactgcttctggggcttggtctgctggatttgaggaccagtttcctggactcagaggtggctcccctacatgtgctagttaggtggcctcagctagtaagaataggggtcaacaacaaacaaggagaatttaaagagtactatagtatagctagtctagctttgattagtcctactgtcctttggtgacaggtttttcctacatggttggatgtaagccatcatccatcatgactgtcggctatggcctgtagccaatggcctgtagcctggattctcattggactcccttggttatccctctgcctggcccatcagcagcccatggtgagccatggggctgtaatttaactctcactccattatgtgactatctatggtctcagcatgttgccctggcactgtcatggcctggagaccccatttccattctattgtgtttgctcacagatggtagctgtaaaactggcagaataggtcccactgtttagagcctgtctggttaatctcagaagtcacgttttaaaaaataacactaaatcggttctcatataaactttataacttacactgtgtgactggcgtcttatcttttgacatttctgagaaaaattggatgtggcttcattttatgaacatcgtaactgcagaagcattagcagtcagctctaaagcactctctttcacaataggatgatatacggccttggcatcaggaagtagggggcagttgggtacaccttgggaaacatctttggacacccgccttgttgagactctccttttggtatttagagcatggaataacctgtgacattttgttgtcccaacaatcttgcaagaataagtattatccccaatttatagacaggaagctgaggctcggagatattcctaatggtaaggattgtatagtcaggggctggtgccaattttttaaataagtaaagttatttctaatatttgtggttgaatataacagtcgaaataaaaggttgttaaccattcctcttagacttaaaaaataactggcaaacacatactggtgacctaacacagagcaataacctagtaggaaatgatactcctggaatccactttcatctatagcatcgggttatgtccacttgaattgtacacataagcctatcactgaagctcaaaaatccacatctccctgaaaactttacttgccctgcattgcacttccaaggaaaggttttgtttagaaactacgcctgtcttttagctacaactcacacatagatgacaactctgttgaagctttgtctagggaaaggggagacaatcatgaaatattggcattgctgtaaagtcagaaatgtatagaaatataagctaatcttctggttttatatatgagcttttccttatgttatcagaacgctcttgattatctcaagaaatattcgcaaaatcctcttccccaaatttatttcaatttgatttgcttaaaatttaattgcttttatgattttgtcaaactaattagattatttccaaagccatgttaactttatttgaagggagaaaatctgagaaaaacacaattttaatactatacacaccactggccttttccataaatgtatagatatttctcatagaaacatccttttcctagtgaatagaggggagtaacatggtgaaatcaccaacatgactctatctgccttgcatttgggaggaataaaaataaccttatttcagtgaagcatggaatttaattggctcccgatcttttcccctcatgcatctggtggccagtattacagcagaaaattttaaactagaaggagacataatccaattaaatttccttttaaaaatgtcaaagcaaataaatctagggcccattagctcacacacagctttgctgttctcactgggcagctgctgtttactgggttttcatccagtgccatctttgcttcccatttcaagggtgtgcgattttacagatcggcagctacattttttcaccactgatgaacgagtaatttattgccaactggtttgacatcttaagtgcctcgagtgacagccagcttggaagatgtcatagggccttcttggagacaatgattcccagacattttagaatcatgatttttgtatcattgaatttcactctgcatttcatagttcttccttcttccagaaaacactatgtggcatgtattgtttatgctccagattacatcaagttttcttctgagatttgggtgctgtcttttgagttatctggaagtgacttggagactctggatccatccagtttgccaggaagttgctttgtttcaagctgtgctgtggctttcttaaacatattcttaattttgataaatgcaaaattgcatagaatctacatctgacttcctctagaagcagacttggagacaaagatttaagtgtaaatcatttttgggggaggagtgaaaacactagtaaggaagtgggagagtgagaaaggaaagggaaggagctactaaaggcatattagcaaaccagttacaaatgtagatgatgtagacgattaagagttttgttttgttttgttttgttttgggacagggtctcactctgtcacccagggtggagtgtagtggtgcgatcatggctcactgcagccttgaaaccctgggctcaagcaatcctcctacctcagcctcccaagcagctgggactacaggcccacaccaccacaccccgctacttttttttttttcttttgtagagacagggtctcactatgttgaccaggctggttcagaagtcctggctttaagtgatttcctacctcagccaccccaaatggtggaattgcaggtgtgagtccccacacctgacctaatgattagagcttaatgcaactgggaaacactgacacttcagagtcatcccacccaaagtgcaagggagctgcggtattcatccatcaactcccatcagtcactgtttgagggctgctcttgaagtggaggaaaggaaacaattccctggcacttgtggcttgccacagggacagccaaagcaagcctcagaggccaaagagaagcccaagggcaaaggaacccaggtgctggcagttggaagtcagattggtgtgctccagagtggaaagaatgaggggataggaaggggtgctggcagagcctgctgcacgtagacagttaagatcccaaattccaaacctgcactgccaggagaatctgttttacagagacacaagtaagcttgttctcacctggaatgggtgggatcaacttctgtggatgactcctcctgttgtaaaagtaccacgcagttattcccacttaaaattgatatgcattgctgggaaagccatatgatatgagtttgctttgcattgcatagtgtaggattaataaaaagtcaatgaagacagtattttaactcactgcccagattttcataaagattctataatatttggaacatttgcagatttattaggaagtacaattaggcagtggtaatatgtggatttcttatgttgccaaaaatgtcttcattttaccaaggggctggccatgagattccttaagtaaatccgattatagacaaaattatgaagaaagtgcctttccctctacttaattgatgcccctcaccccatcccctgagccttggaaacctcccctgtttcctaaccttcctttggtcccaaatttgattccattagtcaattgtaagccaataggtgtgataatctccctgaaattgggggttggcaatagatggacccacagcactgttaatgtgcttgtggcatttatgaagtatttggacagaaagtcattcccatctggaacctaaggaagagtgacaaaaggaaaaataatcaagggaagtggtattgattcgaaagaaagagcacaatggggccggcatagttaggagagctttgtgagagccatggggtttaaagtggtcaggatttaaagaaatggactgctgttatcttttcatcttaaattatccttaattccaaatctcatgaatatttacttgagtttccttgtgcccaagttgctaacaaatttgatctcatctccagattcttgagttgtcaagattgcattttaagttctattattttctctgtattgtcagcatttaaatcacaattccttgctcaaaaaatacaaaaacaaaaccacttttgctgactcataagccatgaggcagaatcttctagtcctgacctgtttcataagaggatccagtccccgaataatttcatcatatttatatgagttacataatgcattatttctgtgttgaaaacttttatttggaagacctattagaggatggtgatttttgaaggcatatatttgtactgtttctctataatgagattaaatttacaaacatcacttaagagcaaatattgctgtaagttttgtaatgaaatttttgaggacatgttaaatagtggagttgaatgactattgatcttagccttcattgattaaaatatattgttttgtgtgtgtgtgtgtgtgtgtgtgtgtgtgtaatggtttactactttttggtgtaagtagtaagtagtaaagtagcaactttgttttaccaagttccatgtggtatgagttgcacaaaacaccccttaggagtgggtttagccatcagccgtctgaatggtgatttccctcttcatactgccagttggtggtttgggctcaacttctgagaggcagcatccttgagagagaagagtagtgtcgcttcaagaactgccttgttttctacttaacttttcttgttggaagtgtgaggaccaaatgtagctatgtaggacgaaagccagctgcttctgaatagatccttgtcagctctggagggtagccccgcagacgagcatagttccgcagctccactgcccaggttattataatccaggcttctccactgactggaggtttgacttgagacaatctatttaatccttctgtgtctcagtttctttttctgtaaatagattatcatcataatacttatctcgtaaggggtttctgtgatgattaaataacttaatacatgtaaaacacttaaaagagtatcagccatgtagtaaatatccaataaatttattgttattcctattactactaggtaattacaagattcctatctataaccctgcacaaatctgcaactagtttatcatcatcataaatcatctctgaaattaaggttttacacctgaattagagatgctggtacttagttctcttctgattctatgacaatgttatatttcatatatgactcatatttcagtgacttctatatctttgcacagttctggattctagctctgtgctatatagaaccgtatttacagatgtttaccagaatcttcaccttgatgtcccatggacacctgaaagaaaaaatgcccacagttgaacttagaatttccctctgagccttgttttcctactaaaaaatgtttttcaacttttcctgctttccttatgatataacaccggattgaatattgtcccctccaaaactcatgtctaccctaaacctcagaatgtgaccttatttggaaataatctttgcagatataattaattaaaatgaagttatgctggattagagtggaccctaaatgcattgattggtgactttataagaaagctgcgtgaagacatattggtatacacagagaacaccatgtgaagttggaggcagacgttggagtgatgtgcttacaagccaaggaatgactgccagccaccaccagaagccaggagagaggcatggaataaattcttccttagagcctccagaaagatccaacgctgccaacaccttggttttggacttctggccttctgaactgtgaaagaataagtttctgttgctttaagccacttactttgtggtactttgttacggcagccccaggaaactaataacagacactgtcaactattactgaatttagaattcttagaaccatccttacctgtattagtttcctagtgatgccctcacaaagtaccacagactgagttgcttaaaacaatagaaatttattcttccacagttctggaggctagcagttcaaaatctaggtgtcagcagggccatactttctctgaaacctgtgtgggaatccttccctgcctcttcctagactttgatggttttctggcaatctttggcgttccttggtttgcagctgcaaacctctaatctctgcctctatggtcacctggtgttccccctgtgtgtctctgtctttacctggctgtctttttatagggaggccagtcatattggattaggggcccaccctactccggtatgatctcattttgctcatcttaatttacctaattacatctgcaaaaaccctatttccaaacaaggtcacattctgaggtactagggattaggacttcacataactcttttgcatgaggacacaactcaacccatagcactacacctttcttttgtcaccatttcaagttgatccccttctagctatttcatgttctcctgcagcagcatctctcagagtagctcctgtcctccatgcccgcttcagccaccctggttatggcacagtcatttttctgcggtattatagtactcacctccagattgattttcttacttcatgtcattctctgtacatccagcaagttagctaatcagtttctaatcagatttctgtcatttccctggccaagacctaccagtgacttcccctaaccacagcctcaagtataaactagcacagaaggccagaagtttggccccagcttctccttctaaccatctctcttgccactttgcaccatgtgccgcaaaccacactgggctactcaccctttcttgaaaatagattttagatctccaggcctttgcttacgctggtccctatgcctggaatacccttcacaaccctaaaccctctgctgaactgtttttcatcccataaggtgcaactgaatcaccacttattcagcttgcttccaaaattccatcacatcaaattattgagcctttacctatgtttctgtgacaccttgtgattctggatactaatgtaacactagtaaagatatagaacctcttatatacaacaattaaccttgacagtcatattttaaccttgaaagtagaaatataagcaaccatatgtatgaactttgcctcctgttgatattaattaaccattgaggcatatgcaaaaagtttgtgtgtgtgtatatacacgtatttatgtattatataaaatgtgcatctgtgtgtgtatatgtgtacacacacacacacaaataaagtggcttatctgcaagatcatactgtgagtgatccagtgttcttttcattgtttactgaagaaacagtaaccaatcagccagtatagataccagtttgtattttaaaaattgggttctttaggcagcagttcacgtctgtaattccagcactttgggaggctgaggtggacatataacttgaagccgggagtttgagaccagaccagtccggcctatatggcgaaacccgtctcctagaaatacaaaaattagccgggcatggtggcatgtgcctgtaatcccagctactcgggaggctgaggcatgagaatcacttgaacccgggagttggaggttgcagtgagcagagattgtgccagtgtactccagcctgggcaacaaagtgataccctgtctttaaaaaaaataataaaataaaaataaaaattgggttcttaagaaagtataggaggatctatcagcgtattcatgctgcataacaactccttaaatttcaatggttcacaacaagacacatttctttttcttgtctatgggcatgtaggtcagtgaagcatggctggattcagctaagcttggctcttagtccgcaagtccagcctggtctgatccaccttggtcattctaagaacagcagcatcctgggccatgttcttttcatggtgatggcagaggcacagaaggccaagccaaatgatgccagcacgctagagcctctgtccatgatatgtctgctaatagtacataggtcaaagccagtcatgtggccaaccccatatcaaaggaacaggaaaatatacccttcttactccacaggaggttctacagagtcatatgacaaagagtgtgggcacataattcttatacagggagggaatgaagaatcaagaacaagtatccagtagaccacaaagtccttatgaacctaaagtagatggtagaaattttcactttgcaaataaactggtgttgaattttcaaaactgtactttgaaatgtggttctaatcatatccatttttggtttttttctagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcttaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatg

SEQ ID NO: 3363 - DNA, 195007 bp, human
gggggccaaacaacacggccgggaggcgccgctgcctgccgggccctctcttctgggaccctggattttcggacactgagcgccatggccctgcctctgctgccgggcaacagcttcaaccgcaacgtgagtaggaagggcgtccgaggtcacagctcccggctggagtctggggtccaggcagggtcgtggcgtggccacctccgcagactctcctggaggccccatgctgctgccctgggttggtggcaacttggaccaaactttataggctgcttctcccatctctccagctgcatctgaatgtttttcctaatttagaaatatatagagagagtccttataggtggcaggaccctcaaaggtaacaaataatagtgacgataaccattgggggtttaatgtgtgccaggcgctgtgctttaatcaccttatgcagcatccagtgtcccaacagccctttgaattaggtagtttttattcccagttactattgaggaaactgaggcacagaaccacacagtctcagtggtgaagctgggtttctttcaagcaaccttgtctccacagctcaggagcctaatcattatccccagtatcctgtgtgaaaaaagataccgtttcaattatcaaattgaagaaatctggcacttatcaagaggggtaggtggcagataagagttctatcagcctgtaaagtttactcccaaactttatagagacaggcacccaaacttggagggattttttttttctctatttataattgggaggggttcatttctttttttttttttgagacggagtctcgctctgtcgcccaggctggagtgcagtgacccgatctcggctcactgcaacctccacctcccaggttcaagcgattctcctgcctcagcctcccgagtagctgggattacaggcgcccgccaccacaccggctaatttttgtatttttagtaaagatggggtttcaccatgttggccaggctggcctcggactcctgacctcaagtgatctgcccgcctcggtctcccaaagtgctgggattacaggctgagccactgcgcctgtcctggaggggttcatttcaaaagaagatgaacgtacagaacaaagcaacacaacacaaaaaaccctgagcatgaaagaacttttgccaataaatagcacctcatttaaacgacagcaggaaaatgattcaggcttttgtttatactggttactacccttcacttgggtcagccatctgtgtctgcaggagaagctaattcccaattagatgggagggaattagatggagccactcaaggcaattgtgtaaacctttgataactttagaaagcaggcagcagattgaagtatttggctttatggtttccaaacactgtctgtatctaagttgttggccctgaagtacaagttttttctttgtagcttcacgccattgaattctgacccctacacgtctggtcagtccaactttgaacactgatttgtgcatttcttggttgatgggcagaggctggccttccagcatagcattgccctttggtaagtttaagccagtcacgcaaacaagaaaggcccctgagagacgggacatgaaaacagattccagaagtaaagaagcatgctgtgtaaaagtaattttaataaaaaatgaaagtaaagcctacagctttttgcccagcaacactctgattaccagtgcctgcctcctgcagaagtatcatagctctcacgtgcagtgattaaggatgggaaggaaaaacagtggatggatgaaatattaataaatctgcaaggttctgcgtatatttttgctttttaaaaaactttaagatcatgaagtacaacacatatacagaaagatgcacaatggatgatcacaaaatgaatatcaagaaattaaatatgggggctgggcgcagtggctcacgcctgtaatcccagcactttgggaagcagagatgggaggatcccttgagcccaggagttcgagaccagcctgggcaatatagtaagacctcatctctacaaaagattgaaaaaattagccaagcgtggtggcacatgcctgtagtcccagctactcaggaggctgaggtgggagaatcatttgagcctgggaggtcgaggctgcagtgagccatgattgcattactgcactccagcctgggcaacagagccagaccctgtctcaaaaaaataaataaaataaaatatgacctgttctccaaaaataccacccttgactggggttgccagatttagcgaataaaaatacatatctcaaatactgcatggaacctgtttatgggaaaggattatttattgtttaccaaatttaactgagaatcttgtattttatgtgacaactctacctatgaacctttctgttcattaccccatctctactctccagatataaccactgttctggctcctatcactataattaggttttgcttgcctttgaaccttttatcaatggaaatgtttggtgtttattcttttgtgactggcttttttagctcaacagtatgttcgttagatttgtccatgtggctgtctatagaggtagtttgtacatttttattactctgtagtattgcattgtatgtttttcacatcatttatatatacattttactcttgataaatatttggcttgtttggggttgttaagaatagttttactgtgactatttttgttcatgttttttggtaggattgctagatcatacagtattcgtatgttcagctgtagtagatgctgtcaaagtgattatactacttaaattcccaacagcattttatgttcctgttgctccacattctttctaacacttggtattgttagtcttttaaattttagatattttggttggtgggtatagcaactctttgtagttataatctgtacttcctgattcctaatgaaattgagcatgttttacacgtttgttggtcatttgtatgaccatttattggtcactgcttttttttttagacggagtcttgctctgttgcccaggctggagtgcagtggtgcaatctcggctcactgcaacctccgccttctggcttcaagcgattctcctgcctcagcctcccgagtagctggaattacaggcatgcgccatcatgcctggctaatttttttttttttaatttttagtagagacggggtttcaccatgttggccaggctggtcttgaactcctgacttcaggcgatccgcccgcctcagcctcccaaagtgctgggattacaggcgtgagccaccgtgcctggctttatttgtatgaccatttattggtcactacttttttgtgtagtacttacttatctcttgtctaatgtttactgggttgtctgcctatttcttagtgatttgtagaagttctatataaattttgggtatcttcttgtctgtgattggccttttccttctcttaatgatgtttttgatgaataatttttggaaaagatcactctttctccatgtctctgcagagccactttgtcaaaaatcaagcatccagctacgtgtgggtctatttctagactcatgaatatttaaaacatttatttactttatgcctgagaacaatgggagtgtgtgcgtgcatgtgtgtatgtgcgtgtgtactagagaatgacagtaccttggactcattcaacaaatcagtatttatttattgagtatcctagtatatgccaaaattaggtgactacatttaaaaaattgttacactagccttggtactaaatgtactgtgtgttgcccacaaattaatattttaaaaacttgtacttagttaaaagattggatgttctctggcatagaatggttagaaagtcagtaaagccatatctggccttttagtcttgcccttcccccctcccctgcttgctgaattaaattaccaagtgaaaaaccttggcctcctgtagatagcataattacttggctgtttggatttaaaattataacacagctaacttttattgcttttccatagaattgaaaaggaacttatgtgccccttacttagctgccagtggtcagtcaaaagcaatagattgatttctgtccacggctaggtgatacgcaacctgtatttctctctctcaaatacaagaagtatggtgccttctaaaatatgaacatttgtacctctgatgacattacaattattttgatatgagttgaaaaccttagggaaatatcacaactaaattctagatacactgtatcttttttccaacaatttccatgctgaacttgtattgagcaagagaatcttgggcatattatcaaaattgaaaatattaaaattaaaagggacatttccagccaaagccaaaaatcctttctgcagtattttggacagatggttgtgtggcccatcctgatcctgagtgtctctaatgaatgatgaagagctcactctttctgctttttttttttggagatggagtctcgctctgtcacccaggctggagcgcaatggcgccatctcggctcactgcaacctctgcctcccaggttcaatcgattctcctgcctcagcctcctgagtagctgggattacaggtgtgtgccaccacgcctggctaatttttgtattttgagtagaattggggttttaccatgttgatcaggctggtctcgaactcctgacctcagttgatccacccgcctcagcctcccaaagtgctgggattacaggcgtgagccaccgcgcctggccgctctttctgcttttaatgaagctaccttgccaccatcttaggagggtttgctgtaaatagcccatcatctaatttgtagtgaagcaaagtcctccttaagaaaaaagaaaacatatttgaatttgcagcaataaaaaaaaaaggaatttaatgaatcatgaccagctttttttttttttgaaaaggaaaaaagaaaaagaagagagtggggtagaatgaagaattagagtgtattatgcttgagaggagttaagtgttgcacggacctttttgtccttcctgtgtgtgcttgtgtatgtatgtgaactggcctgcactaaaatatgcctattactgtggttgtgcaatcagtgtttgaaaaacactcattcgagccatctccatctttttttttttgcgatagggtcttgctctttctcccaggctggggtgcagtggcaggatcacagctcacagttcactgcacgcagcctcaacctctcgggctcaagacatcctcccacctctgttgccacagtagctaggactacagacatgcaccaccatacccagctaattttttaaattattatttgtagagatgcggtctcactgtattgtccagactgggcaattcttatttaaatttagatcttcagcttctttcaaggtcagatctcatctctcacccttcaaagagccttgtcagcctttcttaatgtatatttttaaattttttgaggtaaatttcatgtaacatgaaattaaccactaactatttaaaagtatacaattcagtggtacttggtacattcacactgttgtgcaacaactaacacctctaactagtttcagaacattttcatcacctcaaatctcaatcttttcaccctggaggagtctttgaaatgattttgaggtcttagagaactcctgcataaaaactatatctatagcccatggtacattagcacaatctgtgataataaatatgtaattacataaaaagatgttcaacattatagctattagggaaataagaattaaaatcaagatgagataccactgtatacctattaaaatggctaaaatccaaaacacaataccaattgctcacatggatttgaaataacaggaattctcactcattgctggtgggaatgcgaaatggtaatttcttataaagttaaacacacacctgccatatggccagttccgaatttatgtgaaataaataaattcccataaataattctgggttaaactcaaaataagcacatatcaatttcattttcaactggaatgagaatattgtagctataataatccaataataattgtctttttaaagtaaaaaatggtagttttctgtggatctcttgatttcagccaacttatttacctactctttccctttctcacaaagggttatcaaccctaaagcaagtgggaatgtagaagaggaaacttcaggttgttttatggtaaaattttctacttgatttatttttcctttttaccttatccaagtaggcctaaaagttctctatagtttctattatagagggtgctattgaggaatgatatatggtatatggtatgaacaaaagtagttttctcccctattaaaaactgaaaaggactttttaccagcttttttgagggaaaaaaaacccaaaacagatagttaaacttagcttacctttctttcctttccatacattcaaaaaacttttcagtcagcataatataaacatgttaaataattcaagttatttctgtttatatctaagatggaatttactttttcaaaaagtaggctaagatgatttaatttaaataaaggttgtaaactcgtaattaatgctgttttcaacatcaaaatgtattgacaatgttacataataaagctactaaaactatatgacaaagcattatgagtaaaaatataacctaagatataattttatacaagacttaaaaattaggttcttttactgactgacatgattgggcttaaatataggcagttacaaaattataatcttgatttctttatagacctgtatgtacataacagtcttattttttaaaagctaaaaataaataataaaatttacctctccactctgaaatctgtgtttatattttgccacataaataattccgggtcaagcttgaaataagcacacatcaatttcattttcaactggaatgagaagatttctggccttttcaatacttgttaaacaaggaaagctttgcttacatgtataagaagttgaaaattatagcaaaatggtcattgctctcctatgaatggcaggatgcttacttttatgtaaattttgaactggccatatggtaggtgtgtgtttatcttgataagaaattaccattttgcattcccaccagcaatgattgagaatttctgttattccaaatccttgtaagcaattggtattgccagtgttttggattttagccattttaataggtgtatagtggtatctcctcttttctctctctctcttttttttttttgagactgagtctcactctgtcgcccaggggagtgtagtggcgcgatcttggctcactgcaaccctctgcctcccagttcaagctattcttctgcctcagcctcccgagtagctgagattacaggtgtgtgccaccacgcccggctaatttttgtattttgggtagagacggggtttcaccatgttggccaggctggtcttgaactcctgacctcaggtgatccacccacctcggcctcccaaagtgctgagattacaggcctgagccaccacacccggcctggtatctcctcttgattttaatttttatttccctaatggctatgatgttgaacatctttttatgtgcttatttgccatccgtatatcccctttggtgaaatgtctgttcgtgtcttctactcatatttaattggggagtttccttacttgaattcctgacctcaggcgatccgcctgatgagttttgaaagtcatttttaatatagtctggatacaagttgggtgcaagtctattattgaatgtatggtctgtaaatattttgttccagtctatggcttgaattttcattctcttaaagcaaggctaaaaaatatgtacatatatttaaggataaaatataacatgagttcaaaaactattgttttcaatgcaaattaaggattatagggtttttacttctttgattttatatatttacatgtaatcttgcttcataagtacattagctgaattacttatcctaacataaataaaaatatacaaccatataataatttttaattaataataacattattaacaatttgagttttgaaaatagtttaagatttctttatagctatttctgttgtgagagtatatcccaccaggaatgtatagtcaaattactgggttttagtttcatttaaatcattgctgtcggtatggttaagtcaccaactcagtatctagttaggttcatttgtttcattgtgcttttgtttctgaacttaaaaaaaggcatttgtatggtctcaaagtcaaatttgcaaagtaagttactttcagagagctctagcttttatctctgtctcttcaatcttattctctccctctctccataataacttaaagaaaaaactttatttagtttgaggttatcctctttctcttcctccttctcttctttcttttttttttaatttttaaaacagcaaattgttaaatttattcacatgttccccttttattcaatacttggtagcataatctacacagtcttttgaaccttccttttttcattttaacagtatatcttggagatcacttggtagtggtatatagggctcttcctcatttctttttatagttacatagtactccattttgtagacttacaatagtttattcaaccatccccttttggtgtacagttacattatttccagtcttttgttatccaataatgttgcaataaatagccaaactgtgcttcaaaagacactatcagaaaagtgaaaaagcagctgacagtgtgggaggaaatatttataaagcatattatctgataagggactatattcagaatatgtaaataactcccaaaactcaataataaaaagacaaataggccaggtgcggtggctcatgcctgtaatcccagcactttgggaggctgaggcaggcggatcacctgaggtcaggagtttgagaccagcctgactaacatggagaaacctgtctctactaaaaatacaaaactagccgggcgtggtggcgcatgcctgtaatcccagctactcgggaggctgagacaggagaatcacttgaacctgggaggcagaggttgtggtgagccgagatcgcaccattgcactccagcctgggcaacaagagtgcaacttcatttcaaaaagccaacaaacaaacaaaaaggcaaataatccagttttggtggtatgggattgctgggcagacaaaacaattgctgtctactatgctagatcacaggatagttttgatataaagaattctgtcactttgttcccagtaactattaaaatatccttgaaattacattatttcagattgggccgcttattgaagctgccatccatactttggaaataacatattccattgctattcctaaatgttcatttgaatttcaggaattagagtctctttgcctatgtaggattcaaacacctaattttggtcaccatgcattctgtactgaacttcgtagctctgtcacctagggtacatttgactataagtcacagaatacctgactaacagtggtttaagccaaattaattttctcataagaactttagaggtgtagcagtttcagatttaggcagtgactgatgaatgtcataaagaacccaggctctttttatctctgcattctgccatcttcagaatattggcttttctttcttaggcttgtgacctcatagttgcaaaatagttgcctcagttccagtcatcacaactacatgtaaccatgttcaagacaagcaggaaggagagggaggggaaacagctcttcttatatgagaaaacaaaatgttttccaggagccccccagtagattccctccttccatcttatttgctaaaattgatgcacatggccatcctttactacaaggaatgctgggaaattatcttgttttttttttcaccatctacttttggaggtgggaaagggaaaagagggttcaatagtggccaacaaactttgtcacaccagccacagacaatacctgtgagtctggtattgtcagacttagtagtatccctttcattacaatttgtgtttttaaattatacaagtaacacatgagtatatcaatattgcgaaggataccaagaatactgttctttgtaaactatcttcttttccataatgggaaacaagcctaatactccagttaatccagcatgttcactgtttgtcctttgggtatattttggacttttccactcaattattagtttgtttgtccccttgcctgatagcagcatcctcatgcctcttcctcttcccatctagatcctgaccttccctcaaaacttggctttaatcccccctcctcattaaagccttccccgatcatctcagcaagaaccatctgtctacataagcttgcatgctcatattgcccatttaccgccttatttcctgcgttgtgttttgtgttctttatgtgtgatcgtggcagtcctcagttgactaagaaactgtgattggtggctctttgggttgcccttcacgttctcagtgccttccttacacaaaccgggtccttaataggtgattgtccattgctgcctctacctgcagcaaccatggttgaaacatagatggaaataaacacagcttgggggaatcttctctggaattagtttcctgcttatgtcttccgctgctgctgtggaacaaaatagttcttgttttagcaatagtgaatataaaggatgaagaaagtcatttgcttttgtggcttaaataggagataagtctctcgggatacatggtttatacacagcagccagggcaatatgaagatgtccctatctaaattgtgacacaaagcctctctgtggcctcttgcaccatgctgagggatagttttctctctcttattggcatccagtttgggttttcctggaagcagcaggtttgtctatgcatattcatcagtcaggactcctaaggagaccattctcccctcagtaggattccggctatgctaatggtaaagggatttcttaggccatttcctgggggagtttattctgtttctatagttgcagaaagggcagagccaacttcttgcagaggggggattccctaaagcaaagggtattgagggatgtgcatttttatttcccccttacccaggcccctgggtgctcaaattctacctggtgactccagtgtggcaaagtgaacagcttgaccagctgaatactgaacaaattctttgctttcctaatggtatgtttgacatcccaaaggagggaatggtcaaaacaactagatttttttggggttgggggtggggggaagtttaggtcaattgcatggtttaactgtaatttagactaccttttcttcttcacatgaatttggtaattgaaacatactgttctgttaaattcaagcacagatgtttgtttaatcacttacaggactatttccatatcatttcggttagagtttagtcatttgttgctcagctgtgttcagacctaaactttataaaaggcacgtgagtagagcctctcctagtgactaaggaacgtggaccttctctttccttttttttttaaattgaagtttttattgagataattgtaaattgacatgtagattcacttaagaaagagtacagagaggtcctatttacccctcaccccatttgccccaatggtaacatttttcttttcttttctttttgtttgtaagatagggtcttgctctgtcacccaggctggagtgcagtggcatgatcatagttcactacaacctcgacctccctggattaatcgatcctcccacctcagccccttgagtagccgggaccacaggtgcacaccaccacacctggctaatttttaaaaattattttttctagagttggagggtcttgctatgttgcccaggctggtctcgaactcttggactcaagcgatttgtctgcctcggccccccgaagtgttgagattacaggtgtgagctactgtgtccagctcatttttcaaagctatagtataatatcacaatcagtatcttgacattgatatactccactgatcttattcagatttccccagcttcacttgtattcatttgtatgtttgtgtgtgtgtatttagtctaacctacacatgtggtgcaatgtatacatttccaccacagtaaaggtataaaacagtcttatcaccacagggattcctcatgttgtccttttataaccacacctcgctcccttccaccaactcccccaaccctaccattcctaacccctggcaacaacgaatctgttttccatttctaaaattttgctatttcaaaatgttacataaatggagtcataaagtatgtaccttttggaatttgttttttccacttggtataagtccctgggcatttatccaggtggttgcgtatatcaactgttcattcatttttactactgagtagtagttcatgtatgtatcacaatttctttacatttgcctttggaaggacattggggctatttctagtttttagctattatgaataaagctgctgtgaacatgtatgtacaggtttttgtgtgagcatacattttcatttctctaggataagagcccaagagtgtaattgcgtgttatttgatacttacatgtttaattttataaaaagacaatcaaactatttttgagagcaaattaccattttagattcccaacaatatatgagtgatctagtttctttgcaccctggtccgcatttagtgttatcactatttttattttagctgtctgagaggtgtgtagtgatatctcatggtgggtttaattggcatttctctgatggttaattaattgaatatcttttcatgtgcttatttgtcatctgtatatccagctaagtgaaatgtctgtttatgtctttggctcatttctaattggattgttttttactaagatttatttatttatttatttggagacagagtctcactgtgttgcccaggctagagtacagtggcatgatcttggctcactgcaatctctgcctcccaggttcaagtgactctcgtgcctcagcctcccaagtagttgggattacaggcatgagccaccgtgcccagccttgttttttttactgttaacttttgagaattctttatgcattctgaatactagtcctttgagatgtggtttgcacatatttcctcccagtatgtggcttatcttttcatcctgttaacagtatcttttgtagagccaaagtgtctcattttgttaaggtctaatttatcggtttttttcttttatgagttgtgcttttggtgtcaagtctaaggactcactgcctagccctacatcatgaagattgtctcctgtgatggtttattttgagatggagttttactttgttgcccaggctggagtgcagtggcacaatctcggctcactgcagactcaacctcccaggttcaagcagtcctcctgcctcagccccccaatagctgggacaacaggtgtgcaccaccgtaccaggctcattttttttttttttttttttttgtagagacagggttttaccatgttgcccaggcttgtctcaaactcttgaactcaagagatgcacctgcctcagcctcccacagtgctaagattacaggtgtgagccactgtgcctggcctcctatgttgttgtttttttctaaaggatttatagttttacattttatatttaatgtgatctgccgggcatggtggctcatgcctataatcccagcactttgggaggctgaggtgggaggattgcttgaggccaggagttcaggaccagcctgggcaacataaggggactttgactctacaaaaataataatacaaaaaagcccggtgtggtggggtgcagctgtggtcccaactgcttgggaggctgaagtgggaggatggcttgagcctgagagatggaggctgcagtaagctgtggtcacactactgtactgtatcctgggggacagtgtttgaccctgtatcaaaaaaaaaaaaattctgtgatccattttaagttaatttttatttaaggtgtgagatttaggtcatgatgaacttttttgtcctatagatgcccagttgctcaagcaccatctgttgtaaaggatatccttccattgaattgcttttgaatcttttacaaaaccatttgagcatattcgtgtgggttgtcttttgagttgtctgttctgttccattggtcgctgtgtctatccgtctgccattgccacacagtttttattactgtatctgtatagtaaaccttaatatcaggttcagttcttcctcccactttatttttctttgtcaagattatttgtcttttttttgtttttcctaatatataaagaaaattactctttaggtcagttaataatcttattctgctaaaaaaattaaaagatagcttttagagactgcatgcgttagtttgtaatgctttctcctgaaagtaatggaatacctgactaatagaggcttaaagaagcagggatttatttttttcaccaagtaggaagcctggaggtgttaccagcggagggtgttcaggttcttggcatcgtgaacaaagaattggacaaaatgcacaaacaaagcaaggaaagaattaagcaacaaaagcagagatttattaaaaatgaaagtacactccacagtccgggagcgggcggagcataggggctcaagagcccctttacagaattttctggggtttaaataccttctagaggcttcccattggttacttgacgtagaccctatgtaaatgaagtagtggcccagcaatcagtttgactggttgcggaaagcaaccaatcagaggctgaagtgaagttacaaaggttacaccctatgcaagcatctgattggttgtggaaagcaaccaatcagaggctaaagtgaagttacatagttacactcctatgcaaactttctgcaatcaatcagagatactttttgctttctgcagccaatcagatactttcaattttccatctgccatgcagaaaaaggtgggggtcacggggagattgcaaagggagtagcctcccttgggtctttttgttacttaggtgtggaaagttgtggttttccttttgatttagttctaagaagtcagcgtaaattggccttaggttccctgcctccagaccctattctcttgcttcagaggtagatggctgctggcacatgtatagaggctcagcattgtctcagccagcatttctgcaatcttgcccattatcccaagatggctgctgcagctccagggatcatatatacatttcaaggcaagaagaggtgaatgaggggaacgtgacctgtatctgtcccttggctcaagagagcaaaaatccttcatagaattccaaaacagactcctaaaaagaggctgaggaaacaagtgcagtgtgtagctttttctggagtttttaaatggagacttgcaagggagaaggaatttgggaatggctgcacgaatcagctaccgtgagccagtggtttcaacttactttgggtaaaatctttagaattctgtttattgattggtgccttaagttgaattatttagagcaaaaatatcatagccttatgagaaagattctgcagatctccagatcttattgatttaaattttgtttttcactctactgatttaaatacattattaaatgtataaaatcaatcttattgttatattgagttgatggctaagaatcatgagcacaacactttttcaagttacttttagaaagagaggaaattagcttaaaaaatgtttgagattttctttgacgtgcctttttaatttgcacatttggggttagtttttgagtgatttagcttaattaataagtaatgatggctttcatgctcttatagtcttacattcttagatcccactatacctgaggcaattttgttattttctctgggaggttcacagtatctgctgaatgactttttcttctccatgaaagtacagcaaaaaagaaaagaataaatgaatttttaaaataaatattagacgagggaggaaaaaaccccacactattcacagaatagaagcaaattagtccagaacctgatcaggcagaaatatctaagaatgatagttttagataattctgtatcaaattttctattaacctaaaaaaatagaaaaataagttgtgttaatgtttattgaaatattaaatattaactatctctcttcaattcccaaatttccagtaactgctggtgactgtagagggatttctacagcactctcttttaatacttccccagcttttaagggattgagtctagatccaattatttggtctatttcctcccttccgggtcatggtggatgtttttgctattatatttgccaaaagcaaaagtaacaattcaatcctgatgacttaaacaaggagacatctattacttttctcaaaaagcacaaagaatatgaggcccattgcttaagggctcaggtgttgggtttgcattcctggattcaccacttatactagttgagtgaccttgggcaaattactaaaactctgtctctcagaatccccatctaggccagacacagtggctctgcctgtaatcctagcactttgggaggccgaggtgggcagatcgcttgagcccaggagtttgagaccagcctagtcaacatggtgaaaccccgtctctacaaaaaatacaaaaattagccaggtgtggtggcatgcgcctgtagtctcagctactcaggaggctgaggtgggaggatcgcttgagcccaggaggttgaggctgcagtgagccatgactgtgccactgcactccagcctgggctacagagtgaggccctgtctcaaaaaaaaaaaaaaaaaaaaaaaaaaaaatcagactccatgcataaaatagggatgatgatagaatatactcagagatttttctctctgaggattaagagcattaaaaaatttgcatatctcatttattaatgaggttaactatattttagtatgtttattggctatttccatttcctttttttgcaaagtgccttttcaaatccattgcccatttttctgttgggttttccttttcttagtgtacatatatatgagataaagagtggtctttccatatgtgtatacaatgtgtaatgagcaaatcaggcatatttatcacctcaaatatttatcatttctttgtgttgagaacattcaaaatcctctcttctagctttttgaaaatatataataaattatagttaaacatattcatcctacagtgctacagaacaccagaactcatttcatctatctactgtaattttttatctgttaaccaacctctccccacctcctctccttcccctttccagcctttaatactcccaatgattaagagaatttaatgtggccagacatggtggctcatgtctgtaatcccagcactttgggaggctgaggtgagcagatcacttgagcccaggagttcaagatcagtctgggcaacatggtgaaatctcgtctctacaaaaaatacagaaattagcagggtgtggtagtgtgtacctgtagtcccaagctactcaggaggctgaggtgggaggatagcttgagcccaggaagtcaaggccgcagtgagctgtgatcacgccactgcactccagcctgggtgacagagcaagaccctgtctcaaaaaaaaaaaaaagtttaatgcttctaaagtgcttagaacagtgctacaattgttagctattgtggcaatagaaatgacatttatattggcttatctagctcatggcttatctagtaagctgtcccattcttaccaggcacctcacactacctgcctttgtcttgtggttgtcaagcatctgggcttttgagtgtaggctagaaagaaacaagagactgctgtgctggagttctgaaatagaggttgcaaacagatcaacagctcctgatgtagatgactatagccagcttctcagtttggattaactttacggtttctgtagcggccttgataactaattgattaatcaacttatgcatgtgataaaattgcccttccaatttttagcaacgaggaaggggtgctgattgtagctttgaatttgatatgaagcagagtctggatttggctgccacctttccaacagtggtggaatgggaatcagggagttgagatgccaaggagcactgacctaggatctaggaatagttatgttcctaactttatcatttgctaagacatttgctaatttccttaaattgagactgagtaccaatacacagtcactatggcaaaggcaggttgccatgccatcttaagaggctataatggcaaatctcaagtttttgtaagtgtctgggggtgtgtgtgcatgggggcaaacattttaaataagtgccctatggactgttacatcatatcaaacaaattctcaatgcgttagtttctaaggtatagaattctgaattgaaatttcaagctaatactctaatagtgcaaaaatggagttttgcatgctatgtcaattagaataacaatagcaattggcatcactggacttaaaaaaaagtgtgtgtgttttgttgttttgagtttgaatgtgtgaattcacaactcacaagccaagagttttggagaggttttagtaatagttcctttcatgctaaaagcattgttttaaataattacgtgtggctgattttattttatttagcaagagaattggaaatgattaacaggtatctggataatactctttgggtggagaatttgctcataaatttagctgcaacttggttgaatgaactgcattctgactttgatatattttggtttcttctcaatttttatagcattgttggattttatgggccccacatgcttccacacaactctgttggccttggtggattttaatgtttaaaattaaaaggccccatcatatattcttagttattgttactattatagctggacaaagatatgctggtaagagtttgtagcaattgtgtgtgtgtgtgtatgcaggggttgggggaggtgggtttgcagtggttgctgcccctcaaagaagcaagcatgtagctatccaatgggttcttcttacccactgcccagatagagccgatttctcaaaacagaggaattgcaatagagtttcatacactcagagccagctaaatgggagaccagagttttattactcaaatcagtctccctgaaaattttgagacagaggtttttaaaagatagtttggcaggcaggggcctaaggaatggggaatgctgattggttggtttggggatgaaatcatagggaattgaagctgccctctttcactgagtcaattcctggatgggggccacagatcagatgagccagtttacctgtctgggtggtgccagctgatccatcagaatgcagggtctgaaaattatcttaggttttataatagtaatgttatctatgggagcaattggggaggttagaaatcttgtggtctcaggctgcgtgattcctaagccataatttccaatcttgtggctaatttattagttttacaaaggtgatctggtccccaagcaaggagcaggggtttgttttggggaggggctgttatcatctttgtttcaaatttaaactatcaactcctcccaaagttggtttggcctatgtccaggaatgaacaagagcagcctggaggttagaagcaggatggagtcaggtaggtcacatttcttttactgtcataatttttgcaaaggaagtttcaggcatacctcttttgaccttgttttttccagccccttctctttctcttgcagctgtggtagtgagtaggaaaggaaggttagccttgtggagggctcttgaatttcaatccacctcttcagcctcctttagaaatactagcagaaatgagcctcataccccgtaagatgttgtttaagtgtctgattttgctatttaaggctctctatggattgatttccacattaactcttcaaagttcatgtcccactactataggaaatgcccctgtatctagctgggtctagtcctggtccttcaacatgtttcagtgtcttttactctgcccaaattcagtgcatggttcaaggttcactttaagactcaaattctacatgattttttctctggcatcgactgctccatagtatactcctttgaattcctgtaaccctaatctatatacatagggttggctgtttgctacagtggattgcccaaaaaataaatcataaaaatagatggtatgtttaagttgaagaactattgactcatgcctatcaggccctgtgttaaatgttgaatgtttcttattcagcatttaacatgtggccctgcttccatggaactaagaggaacagtgttaaaagtgacatttaacccaggaatgaagatcacataatttatgtatgttcatggagcaaatattattatggctaagaatgtcataaaagtggagataaatctataaatctatttgtggaaaagaacatataagctcttgggttggttagtaagggagtcatacttggtcccttttttttttagacggagtcttgctctgtcacccaggctggagtgcagtggtgcgatctcggcttactgcaacctccacctcccaggttcaagtgatcctcctgcctcagcctcgtgagtagctgggattacaggtacgtgccaccacacctggctaatttttgtatttttagcagagacggggtttcaccatgttggccaggctggtcttgaactcctatacttggtccctttttattggagctctgactcagttctctctaaaagccaataccaagtccttcctcttgagaaaacaaaataataaatgctaacaggcaggcacaggcacagatattctctcacttagtcctaaccactgtctcgtgaagcaggtattattattctcactttagacatggcaagcctctggagaagtaaagtgactgctccagcatcacatgacccatagaggcaaagctggaaggtgaatgccaggcttctgatgccaggtctcctgtcctatcctttatgaccctattactccctggtgctgctctccattccaaatgtttgattattagatttaagggggtctaagccaggtaacatgaacagggaaagatcagctgacaatatctgattgtttgaaaataatccacagcttatgttctattcattcgatagatgctcattgaacacctactatgtgcaaggccctatagtccttactgtcagaaagtacaaagcctagtataagatgcaagtatataaacaggaaactatagtataatatggtgagtacagtgatggctgtacaggaattatgggtatagaatgaatgaatcaagaatgaaccttgtgagattgtttgtctgtaccactgctgccctttcaaggagcacgtgtattattttttagaaaacattttattctctgttctaggcacttggcctggccctggtgatacagctgggggtgggggaggggaaagggtaagttcctaaatagttaaagagagggtaaccttccagactttaatagaagatctatgcaggaacagaatgttctgcctctggcagtcagagaagactttaagagatgacatttagatgatcttttatttatttcttgcatttttctgagcttgggttattttaaggaaattataaatactagaaactcaagagttttgatttgcaataccttacctagagctgttcaaagagccatatggttcacaagctatttctgtccccatgattctgctgaaaccattctcgtcaaggtcaccagccacctccatgttgccaaatcagggggtcaagtctcaagcctcgtcttcatttgaattattagtagcatttaacacagttagtcacgtgttccttcaaatgctttctttaggtagtttccatgatactaaactctcctggtgttcttcccatcttaccagctgcccctttttagtcttgtttgctaattctaccccatctccctgatcacgtaacattgggatattttaaagctcagtcttggacttcttttctgcactatcatcattcattccagcactgtagccttaaataccatccatcaactgatgtatatcaaatttttatatccagcctcgacttcttgcttgaacttcagactcccatatccacctgctagtccacatttctacttgcttgtctgagtggtatcttgaatgtaacatgtccaaaatagaattctggactcctgtgcctgcctcctacctccagaattctcatttaagttctctcccaccattctacatcccagcacctaaaactccattcttctcgttgttcaggccaaaatacttggggttgttaataactcatctctttttccacaccctacatctaatctattggtaaatcctttttgttctaccttcaagatacatacagaacttgatcacttccactgtctctacttctattaacctggtctaggccactatcatttcttgcctggactattgcaatatccccagttctttgtattgtggccagagcgatcctttctatgccctgctcaaaacaaaatccagtgttccttaaacctctaaggcactggcccctgtttatactcttaacctcatgtctcaagttagaggactctagacctttcaaacaccagaataatgtggtgtcctgcaaggtaaggcctaacaggggaggttgtatgataatccagagtgcaggagtgaatggaggggagaagggactctcggtgactgcagactactgtttcgtgaaacatgaagatagaggatgggagggagtcaagatggtaacgaaagcaagactaagggcactgaaggaggcttttcttcctctaagagttgaaagacttgagtgtctttatgagttcattgaaaggaggccatggaagggagaggctaatgctgttgatcactgacttatcagggacacaagtaagccagtactgcaaggagagacagttaggacccacgtgaatatggaaatcataaattgactgcagtcacttttgtttgcttagttgcatggctttatcccaccacttcactctgtcttctggccagagccttctaattatcttcagtctactaccagcccttttgttatgcctgccagttaatcccagtgccttctcccttgttctgctccaggctcctgaacactgtggatgtgacacaggtcctgagggtcacattgcttcctggatcactattctttgtctcttaattcctgccctcctcccaggtgctttaaacttatctactccaagccagttgcagtggctcatgcccgtaatcacagcactttgggaggccagggtgggtggatcacctgaggctgggagttcaagaccagtctggccaacatggtgaaaccctgtctctactaaaaatacaaaaattagctggttgtggtggtatgcacctgtaatcccagctacttgggaggctgaggcaggagaattgcttgaacccaggaggcagaggttgcagtgagccgagattgcaccactgcactccagcctgggtgacagagtgagactccgtctcataaaaataaaaaaataaaaaaataaaaaaaataaataaaataaataaaaacttatctgctcctgtgacatttgtttgatagggtcagaggctgtgaaactttagaagcatacatgctgtctttggaatttaaaaaatgtatctacatgccaaccgatccattatttacttaatatctctctgtgaattgaatcacttttggaaaactaaaacatatttaaaagggaaactttatatccttaccataaatgaaaaccacatcatttgatctaagtggaaggtcatggtaagaaaaaaagaaatgaaaacaaaacagtgtttttagatttgatgcctacaaaaagttaggagcctgaggcctgctttcttttttataggcaagtatttgggaggtatagtcagtactaccaaattgagactcacccttgccttaatcgaaaggaagaggatagaggaagatgaacattcttgcgcgccctctgaaatcgtctccattaccaactagggtggcatccctggaaagagtgaggcccgggtgtttgtgtgcagagacagcgcaagggttggcatgctgtggcttgcttaatcagtttcagtttaagattggttgaagatcttcatgttaagatatggcagtggcctctttaaaagtcttttgtgcccggcgcagtggcttatacctataatcccagcactttgggaggctgaggcaggcggattacttgagcctgggagtttgagaccagcctggccaacgtggtgaaaccccgtttctactgaaaatacaaaaagagccaggtgtagtggtgggcacctgtaatcccagctacttgggaggctgaggcaggagaattgcttgaacctgggaggtggaggttgcagtgagctgggatcacgtcactgtactccggcctgggcgacaagagtgagactctgtctcaaaaaaaaaaaaaaaaaagtcttttgccttcagaccttcccccttccaacccaccctgcccactgttagtggatctgtcttcagacgtgctgcctcatattgtccctgtgtccctcgggaaactttaatggctccttgttgcctatttgatccagaccacaatgttcaatttggcaaccagtgaatctaccactcaagttttatgggcttcctgtatctgcagcaatatgttagatggtgaggggacatagaaaaaggcagaaatatacaccatggtcccagagtttaaaaaatgtgtcatctagttgagacaaatcaaacacgagtatgtgcacatattatggtgcatgtacacgacgaagggctggtggtcagagaaggcctcatgaatctgcccatccctgggcttggtcatcatatagctcatttgtggtgtgtgaatctcatgctggctggggttttcttttttattgtggtaaaatatacaaagtataaaagttaccattttaaccatttaaattatacaattcagtggcattttgtacattcacaacgctgtgcagctgtccccactgtttcaagaaaattttcatcacttcaaaggaaacctgtacccggtaagcagtcactccccattctttcttcctcccagtccctgccaaccattaatctgccttctgtctctatgaatttgcctattttgtatatttcatataaatggaatcatataatatgtggccctttgtatctggcttttttctcttagcataatgttttcaaggttcatccacatggtagcacgatatcagtgctttgttccctttggcggcagaataacattccattgtatggatataccacaactgtttaaccattcatcagctgatagacatttgggatgtttccaccttttggctattgtaaataatgctgctatgaacatttatgtgtaagtttctttctgtggatgtatgttttcaattctcctgagaatatactgagaagtgcaactgctggatcatatgatgattctatgtttaacttaatgagaaactgccaaactgttttccacagcagccatactagtgtacatccccaccagcaaggtgtgacagttccaatgtctccacatcctcaccaacatttatttttcattttaaaaaaattatagccaccctagtgaatgtgaagcgttatcacagtatatgtatgtatatatgtatttatttttgagacagggtctccgtcgcttaggctggagtgcagtggtgcgatcatagcttcatagctcactacagcctcagcctcgtgagcgcaagcgctcctttcacctcagcctcccgagtagctgggactatacgcatgcaccgccatgcctggctaatttttgtattttatgtagagacaaggtctcaccatgttgctcaggctggtctcaaactcctggactcaaatgatctgcctgcctaagcctcccaaagtattgagattacaggtgtgagccactgtgccaggcttcattgtacttttgatttacatttccctaatgactaatggcattggacatattttcatgtgcttgttggccatttgtatatcttctttggagaaatgagggtcgtggtcaactcagtataccactggaggctatatgagtaaacagcaaactttctcataaatgcagaatgttggcaaactgacaaactgcgtctgccacccagaaggaatgctgagggcagttatgccccaagtgcagtgtttattgtgattaggtacatcagaagcctgttagtaataatatgaacctgtgatcaattaaggagctgaccaatcattacctcctcctccctactcattctacccaataaatacgaagggctgtggaagctcaggggggctgcctttgctcactagaagcagggagctctcttcttccccggacccttcctttaaaacagtttcttttgtcttaagttttcatttctatgttcatcccccttcgttcagtctcgtaatgacggtctcaagtagtaacaatagtaactcttgtaatgacggtctcaagtactaacagtagtaactgttgtaatgacggtctcaagtactaacagtagtaactgttgtaatgacggtcttaagtagtaaaagtagtaactgtcgtggtgacagtctcaagtagtaactgtggcagtctaccacatcctttgcccatttttaaattcaattgtttgtgtttttgctgagttgtgagaatctttatatattctatataatagacccttatatgatttccaaatattttctgtcattctctgggtttctctgttttttagaaatgacatctcactctattgcccagggtggtcttgaactcctgggccccagtgattctcccagcttagcctcttaaagtgttgctgggatacaggcttgagccacctcacccaaacttcattctatggattttttcactctcttgatagtatcctttgacacacagttctaattttgatgaagcccaatttatttttccttttgttgcttgtgcttttggtgccacatgtatgaaacccattgccaaatccagagccatagtgactggcttctattctagggttgggagctgtggcttgcccaaggccatgtccccaaagtctctcacaacttagcacccaatggatgctcaccagatgtttgtagaagggatgactatgtagtgggatgtgagctgacccttggtggggagaggggtttgtgtagaagtatagcctgaccagggacatgactttgaatagacattaaggtaccttataagctgtaagatgtggtctgaccaaagaggagggtacacatgaacaaattgtggaattctgggggacaggtagctgagtgaggccttcaacggtggcaagggctttttccatgtgattatggaaacctagatccatggaggaaacttgtgagtagtggagaaagctcctcaggggaaggaaggctggctgtgacttcatctttataccatactctctagaatagggcctggccggtattaggctttagtaaatattccagtggcctgatgagggagacttttaagatatttacatgagaggcttttcatgatatagtcctccttatatattctactctagctcgccctccttccaaacttgaccttgactttctttttttaccagattcgcccctctcctaggtgctgtcagctcagctgcagtacatcactcctaaccctgcttggaacatccttgcctctcctctcctatctaattcatctcattcctccaggcccaagacagtatccagttatccacagaacctcaacactactactccagcacatcagtgtatggctctagtcagccatacacttagctatacacttaccagagcttagggtcacatgatcttaggttcagatgcaggctccactagttactgtgtaagcttgggtgggccagtctccctctctctgccttggtttcctcattggaaaaatggcagtaataacactgctaaaacagttctgtgacagtgaaatgagataataaatgagatataaaacccttagtaaagcatccagctcatagtaagcggtcaaaaatggtagctgtactgttttctagttgtttgctgtatttggctgttctcgtgttgctataaagaaatacgtgaggctgggtaatttattaaaaaaaaaaggcttaattggctcatggttctgcaggctgtacaagaagtgtggtgttggcatttgcttctgatgagggcctcagaaagcttccaatcatggtggaaggcaaagggagagccagtgtatcacatggtgagagtgggagaaagagagagaagggggaggtcccagactcttttaaacaagcagatctcatgtgaaataactgagcgacaactcatttatcactaaggggatggtgtgaaaccattcatgagagatctgcccccacgatccaatcacctcccaccaggcccccacctccaacactgagaatcacatttcaacatgagatttggagaggacaaacatccaaacggtatcattttatatatctaaatcttgcttcctccgcaagattgtgggtttttttcttcagggcaggggctgagtcttatgcttattttaactcgtatatttggcacaaagttaggactatagtaagtacttaagaaacatttgttggttcgaggtgactttgtgattactcggagttacttgctttaggagacagtatatcattattgaattctatattattctacgattcattttctgaaacccaacttttgctttgttttatggggatctgggactgacttgtggtaatctgattgtatgtgtgagcaagtgtgtgtgtgtgtatgtgtgagagagagagacagagagagagagtggagggaatggtggaggtagcgacaattgattccctaagggacagagccagctacagctcaccatcctaaccactgcatctagctttcctctcccagccctagagctgggctgttatctgcccagggcagctgttatggccctgactcccctggggagggctgctcaggccttcctcattcttccaggctgcctttaccacaaaaggaaatgaggtatttttgaccttatcagacttctctgccaaggcatcatgttttgcaagaggctattgccctggctatatacagtcctgggcagtgtgctaacattaaagaagcaaattcaggataatggttacctctggataagggaggcagggctatgagctctgagataaagcttcagttatctctgaggtatttattttttatgcagggctgtggggcatatgagtgttcatttattatcatgaacattgtataatcttgtatttgctgcttatcatttctatgcatgtattatccataaatattaccgtatttttcgagtattttccagctttacatatgtgtcgtgaaattttatgtgtacttcagctacctatattttttgcctggcagtttttgagatttgtctattttgtttgtttgtttttttgagatagagttttgctcttgttgcccaggctggagtgcagtggcatgatttcggctcactgcaacctccgcctcccaggttcaaacgattctcctgtttcagcctcccaagtagctgggattacaggtgcccaccaccatgcccggctaattttttatatttttagtagagatggggtttcaccatgttggccaggctggtctagaactcttgacctcaggtgatcctcccgcctcagcctcccaaagtgctgggattacaggtgtgagccactgtgcctggcctagatttgtctatattgatacgtgtaatattagactctgtattaatattccatgttataaagagatgtatcttttctgctattgggtagacatttcagtggtttcctatttttcacttttgcaaacaatgctataacaatagtctgatatgcagttccttgtgcctaagacaagatacttctgtaggagtggattggctaggccataggacatatatgcctctctctttgctcgtattgccacatcgctcctcagagtgattgtcctactttaccttcccaccagcagtgcacaaatgttgatgttggccatgtccttgccaacccttggtagttgtatctgtgctttctcctctctctccagatcaccagaaaaggtgggagttaaggtttttcaattaaaggagaatgtcagctctgaagaatttcctgttacatttactttaatgaggaaaagattttgttctctgttttggtgaaaataatgtttagacttctgtggaaaacagttacatacactttttattctgaagcagagcagttttttctttctttctttctttttttttttttttttgctgtttgcattcttggcaaacaagtaggaaagaccaattagcaagctaatgttctaaatatttacttgcagtaacagtcattttttaatgttttatatagcatggaacattaggtttatgtgtactgcttttcaatgttttgaattgattaaaatgaattaaatttaagaatgtgacacaactttatggataaagattgatcataattatttgccactttatttgcattttgtgagggaaaaatacatggtaagaaaatgtgttgacattttacaaacaggttagaaaagtcataaagagtaactttggctattttatgttgtctcttatgttcacaggtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtaagtcacatgacactgggaggaatgcagtcttagcattttacagatgctaaataatttagttttgagaaagtaggagtcttcagtgtaaatgttaaggctagttctttttctttttgccttttctacttattattgcctttatttttagtgttttatttttagtgtttctccctttgtctttatttgtttaaattgacaaacataattgtatatatttatggtgtacaacatgatgttttgaaatatgtatacactatggaatggctaaattgagctaattaacatatgcgttacctcatgtgcttctctttttttgtgatgaaaacactattgtcttacaattttcaaatatacaatacattgttattagctatagtcattgtgttatacaatagatctcttaaacgtattcctcctaagtgaaattttgcttcttttgactaaggttagttcttctgaaaagataaattcaagaacaaaagtatcctaaacaaagaaaaatcattcttgctctgctcttttttatcaggcacattggttgcagaatgccaaatgtttatctttcttggctaatgcttattaacctttctctcatctccttcactggacaggataatctgtcctatagaaactaagagtctcgtcagattgtcacttttgcttttgagttgccattgactaaataattgtgtttgagtctgaatgtggctttaaataggaatagaaaaatgccttctcttcttttctccatactaattagtaataaaccgtagtaatgattccccatccctaagggctaaaatgtgatgtggcaagaagaatagtgaaaggaagtgatgccattattagacaagagttggaattttttaatgtatatgtctatacacatacacacacatatacatatggacatattggcagttagaaaaaggaatgtatttgaatattttttaaaaaggctaagatcagaggaaagaaaaggcgaccagctatatggatatgctgtgtttatcagatagccctgtatcacagcccaatgttctgttctccagaaagaactagttattagattattttagatcctgtaattgaaagatagttcaggactagataaagaattgaaaccatagcatgctaagtttaccaggtggtttttagcagcttttaacatggattggttggcagtactttgattctaattaaaatgtcctcaaattgacacatccccatgtcatctgtgatagggtagatcaattagagtgcacatttttttttgaagcctagttctgacacttatagtgatctaacagaccacagggaggcttccttcctgggaaaccatttctcctttcaacatgggccaatattcttttcttggattattttcagtacctggctcagtgctggacccaaagctcaaaaacaattctgggctgactgacttgggtggattatgcatagttttctgttactctcaatcttataggatgtttactttgcatgggccaaagaaaagattctatttttacctcatgtaaaatagagggtatcgacaatattttaaactaatccactactgaataagtatcgtaggccacaatgtattaatattaaactattctcttgcatttcaagtcgaaaagtcatttcatgtttttctcaatatttaatatgtgcctttcaagcctattttgcaggcctttaattacttatgtagaatatttcatgaatctggaataattttagcttcagactacttgagtaaacgaagagcttgctcatttcagggctaactaaatgcaacataattctttcagttattttgttggtcaacttctattaaatattcattgagctttaaatgagacactaagactgaaatatttacgtgctctgatgagactgtgaactacagactagatcctggttaataccccaagcaaattataaagcgctttctacattagcggttcaacaaaaacaagtcaacacttgttaatcatttgtcttaaaaatgagacattttcagtgcaccccatcccagccgcccggtcccggcccctcactctcctttgccgcgctaccaccatgctctccgtccgcgtcccgctgctgcacattacggacccgcagcagctgcagctctcgccgctgaaggggctcagcctggtcgacaaggtgaacaggccgccggccctgagcgggacccgggttctggccagcaagactgcatggaggatcttccaggagcccgcgagccgaaaactaaagcagctgcccccggcgtggaggatgagccgctgctgagaggaaacccttgccgctttgtcatcttccccatcgagtaccatgatatctggcagatgtatgagaaggcggaggcttccttctggaccaccgaggaggtggacctgtccaaggacattcggcactgggaatccctgaagcccgaggagagatattttatatcccatgttctggttttctttgcagcaagtgatggcataataaatgaaaatttggtggagcgatttagccaaatagttcagattacagaagcccgctgtttctatggcttccaaattgccatggaaaacatacattctgaaatgtatagtctccttattgacacttacatcaaagatcccaaagaaagggaatttctcttcaatgccattgaacgatgccttgtgtcaagaagaaggcagattgggccttgcgctggattggggacaaagaggctacctatggtgaacgtgttgtagcctttgctgcagtagaaggcatcttcttttctggttcttttgcatcgatattctggctcaagaaacgaggaccgatgcctggcctcacgttttccaatgaacttattagcagagaagagggtttacactgtgattttgcttgcttgatgttcaaacacctggtacacaaaccatcggaggagaaagtgagagaaataattatcaatgctgttcagatagaacaagaattcctcaccgaggccttgcctgtgaagctcattgggatgaattgcactctaatgaagcaatacattgagtttgtggcagacagacttatgctggaactgggttttagcaaggttttcggagtagagagcccatttgactttacggagaatatttcactgaaagactaacttctttgagaggagagtaggcgagtatcagaggatgggagtggtgtcaagtccaaaagagaattcttttaccttaaatgctgacttctaaatgaactgaagatgtgcccttattttgctgatttttttccatctcataaaaaaaatcagctgaagtattatcaactagccacaccatgaattgtccataatgttcattaacagcatctttaaaactgtgtagctacctcacaaccagtcctgtttatttataatgctggtagtatcaccttttgccagcaggcctggctggctgtgacttactatagcagtgacaatggcagtcttggctttaaagtgagggttgaccctctagtgagcttggcacagcaggattaaacagtcatttaaccagcacagggagttgaaagttgaaagatgcagcctcactgcttcagcgcagatttcaatgtttacttaaatataaaactggcactttacaaacaaataaacattgtttgtactcacaaggcgataatagcttgatttatttggtttctacaccaaatacaaagcattctcctgaccactaatgggagccaattcacaattcactaagtgactaaagtaagttaaacttgtgtagactaagcatgtaatttctaagttttattttagtgaattaaaatactcgttaaccaactttaaagtcagtcctgtgtttagatagatactagtctgttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttttttttcttttttttttcttttaatacaagaatatgtctctttttattgaggtcttttttatgtgctatgattaaattaaatgagataatgctttaaaagcacttatatgtgggagctaaggtagtattgtaaaacttcaagtcatccttaaacaaaatgaccaacctaagatcttgctcctgttaagtggtgaaatcaactagaggtggttcctacaagttgttgtttattctagttttgtttgtgtgtaagtacgttgtgtgagttaattcatttatatttactatgtcttttaaatcagaaattttttattatgtatgtccttttagattttacctgtagttcatactttaaaataatcacccagtgtcttattctagcattgtctaaatctgagtattatctaggggaatcttaaacttcagtaggaaaccatgagttattcatacagtttccattcaaatattaatttcagaacgaaacaaaatttttttttttttttgagacaaagtctcgctctgtagcccagtctggagtgcagtggtgcgattttggctcactgcaacctctgcctcttgggttcaagcaattctcctgtctcagcctcccgagtagctgggactgcaggtatgtgccaccacacctggctaatttttttatttttagtggagatggagtttcaccatgttggtcaggctggtctcgaactcctgacctcaggtgatccacccacctcagcctcctaaagtgctgggattacaggcatgataaacaaatattcttaatacggctactttgaattaatctgcctttatgtttgggagaagaaagctgagacattgcatgaaagatgatgagagataaatgttgatcttttggccccatttgttaattgtattcgctatttgaacattgtcctgttctattgttagtttccttcatcatttatggtatagtcaatttttaaatctctgtaatataatacattttcctatcttttaagttattgttacctaaagttaatccagattatatggtccttatacttgtacaacattaaaatgaagaaagccaaaaaaaataaaagacgttttcaacttgttgccagtttttccagtagcttttaatcctagcaatatatctagcattacactctcaaataatacaaagtaaaaataaagacagttctttggaaagtgtattaaaattaatatttgtagtagatgctctttgtgcccacccagatccatgctggggtggtgatcccccacccccagctgtgacaaatggtttgacaaacagctcacacctgtaaccctctctggagacttgctcttggctgatgggagttgcatctctcagagacacctgagaggttacactggcccctttcccctaagagggggcagctaataactgatttatcaagggtaaaaaaaggtcagcttccttgcctgaaggggggataattctttgctatgattcaggctccatagcccctcgtgcatcagaccaaggctacacttgacctgagaatgcatccttgcttgcgcggttcatttccctttcctttgctgcttccctcactcccttacaggtttctcccaagagtctgcccttaataaatcacatgcactaaaatccctgtttcaggctctgcctctatggaaccccaacctaagacaacattccaggttttaatccataattctgaaagcaaccaccaaaatgccttgctcaagtagactatcacattacaagcagagaaaatgccttttgcaatcatgaaaaggagccagtatttgttatcccgcatggcccctgcggcagacacttctagctgtttatcctttatgcattctacccttccttcttataggcagaacggttttatgcaggctggaattgtgcccacttaaatgtgttacctccccaggctccttgcagctagggctggccgcatgactcacttttggccaatgatatatgcattaagatttattgggtggggctcgtgggagagttactatttttctaatgaaaacaggctcagcaggtatgattttcctaccctttgccctccttttgtttttcctgtctggaactagtgttaccgaaccaaactgggtccatttacctgcatgcaagggaaagccaaacgccaaagcaccaggtttttgcagcaagaaaggtttattgagttgattggcaaggagacaggaggaaacactcaaatctgtctcctggagctgggggctgggtcgggttttataagcatagtgtaatgaggtgtgatctgattgcatcttgcaatgaggtgatgctgggaggcataatctgattggatcctgctatggggtgacaccagagcacgatctctttggttcctggatcctgccatatggggtccacttcttaattcagtccctgttccttggtccaagcacttaggtttcacctgtgcacacttggttcaactgggcatgctcgggttgtatgaccttcaaccctggggtccacggcaactgaaaaacaactcacgattttgttttataaaagttgaactagattagtctggtgcggttacactaggacataattcctagggcacagcagctatcttgtgagcatgacagagataaaggaaacctaggtccttgttggcatcatggagccactgtttaaggcccaggctgcctctctttggacttgtagttatgtgagaaaaatcaggctatatttcagagattctcaacctagcaaggtatttggaaatatgtggaggtgttttgagttgtcacaatgatcaggagcagggccagactagggtaaggcaaatgaggcacttgccttcggtgcaacatttggggtgccccaaaactcagcaattaagctagataatattttattatctaattattattattatctgttattaagctagtataatattttaaaaaatcaaattaatgccagaaattcatgatgaacaaaatgccaacattttaaataaagacaagatcagcaactgtgccatggaagttatattggagcctgaggcaaaaggaaaaatcagtaatactgatccaatcttcattaaaaatttggcattttgatattttgtttctcctggatattttgcattaattttgttttattttattatttttttttgaggcggaatctcgctctgttgcccaggctggagtgcagtggcacgatcttggctcactgcaacctccgcctcccaagttcaagcgattctcctgtctcagcctcccgagtagctgggactacaggcacccaccaccacacccggctaatttttgtatttttagtagagacgggatttcgccatgttgaccaggctggtctcgaactcctgacctcaggtaatccacccccctcagcctcccaaagtgctgggattacaggcatgagccaccacgcctggcttgcattaattttgatgttttaaatcgcctcaccctagggccagccctgaccaggaggtgctgctaccattgagtatccaggggccaagtgtatattttatatcctgcagtgtggggaaggcaaccctacattggggaaaaattgttctacctcaaatgccaatactgtttccaccgagaaacacagtgtgtgtactacttgcttaaaacccgtagcattgggagaatttctaaaaacaggcaaaagaattttgcttaatactgcacccacccttcaaagacttcgttatttcattgaattcatttaaataaaagcagactatgatggggccaagacaaaaacaagactattccataatcataactgtctgaacacagaacacgaacactgtccaagtcacaaaatgcatcactcacgccagttatttccagtcatcatcccagtacctccatgagtaggaagcaaatatagacggttgtcctcatcatataaatgaagaatcattctcaaggagaaatggagcaggaaccagagtctgagactgggtgttggaggcactgattctggttctggtcccgccattaactatatgtgtgattgtggcttagtcactttacctctctgagcctcagtttccttaactataatgcaggacttggctagctgatctgtaaggcccttttacctctggcaatttacgtctaaaacttgactaaagtcaaattcagcttgtttatcctagaactgagcccagaccctggatctaatggcctaggactctctaattacatcaggcacccactacttcattattaattgaaatttggcatttagcagtttatgctacgctatggtggctgtataagatctatagttagctgcttttataaaacgttggaatatttagaaatatacaaatgactgaatgtttttatatgactttcgtctggaagttaagccccatttacatagactctacaattttgctctcatttttcatttgtcaacagctcctagttagcctaatttgtttgctatttcacaaatgactcagttatagtaagtggcaagataaaagttgatcttatgggatatgcatacatttgaaaatattatttctttttttttccatctattgtaaacataatggttataatcaaaactactgaccgcacaattgaattttaatcacttacattaattgacatcgagcttgtaatgagctgattatttatgtagctgattatttatgtagctgtgtgactctatgatttgaacaatataaaaataaatttttaaaatataatttggtcccctgggtcatcttgatttttttttttttttttagattaaacaagttagtttattattcatttgcagcaagggaaaaaacataccctaagcaactgtgggatgtctaatgaagcaggtgttagaaaaggcttattataggatttgggcttgtgttaagtaattgtggggagtgattaaggaagcagggctttgctctggattgggtgctatcaggaagtaggggtacatctacaactgggtatcttaataaatctcagagggagagaacagactagagtgagtctatacctataattgggagagaagcagctgtcacttctgtgagccaggagagggggatgtttgacatttcatggctggacaaggttcattttctgtgtttagatgtgactgtggagtggtcttggttttgtcttgatccgtcacggtcacagagtggccttgtctgatgttggtggtctctgaaattattcttgtttagcaggagaacaccaaggcctagctgtggatgccaggccagcttgtaacagcaccaagaccagctgatagtataggccggctcctggatgtcaggggctacttttctctttcttacccagtactagctagaatttttaattttcctgcggtaggattaacgaatgatcaggtacattataatttcacttgcttaacaaagaacaatacgtaaatacagattcttgaagttttgcctaaagccagttaggaatgttataaaatataatcagaatatataaaaataaaatacaattaagcttttaaaaaaactggaaaatacattagatataccattaaaccatacccgaaatttcaaatggaaatctttctataggtttatataattctcagattatctgactcttgctattaccatgtcataaaagacaccaacatgtataattataagacaacgtaattgcaatacatttgccgttttaatcccatgttttacatcacaagtacacagatcttcagctatttagttttagagaagaaataaaaaatcttgcctgaaatcaaccatgtcataccccaaattctcaactatgcattctgcatttgtcactaagaataaaacacttagtctttaaatttatattaaagtgataaagcttccaatttcattgtattatgtaggtttctttaatcttcttttgaaattcaaaaggcacttaataaaaataatccccaagtctggaataaatgtttttggaataaaaagaatgagaatcataaatgagccttttactaaagaagagagttcttccttccctcttttctaaaacctagaatttagctatttgacaacattttaaggcccttccctcaggccaaaactttttatcagtaactaggcctgtggcttattctgattagtccaaagttaaaattgtctttttgaactttaacttttgtaggtaccactacatccccattagaatggctataattttaagactcttaccactaagtgtcggtgatcatgtagagaaactagaaccttcatacattcctggtaggaatgtaaaatggtgctgccattttgaaagacagtttgacagtttcttagttaaacatatacttgctgcatgacccagtaattccacttctatgtatccatctaaaagaaattaaaacatgttcacacaaaaacttctgtgtgaaatgtttatagcatcattattcgtagtagccaaaaaacagggaacaacccaaatgtcccttaagtaataatggataaacaaaatatggtatatctacataatgaaaactatacaacaataaagaaacctaatgatatatatgttacaacatgggtgaacctcaaaaacattacactaagtaaaagaagccagacacagaagacttcctattatatgattccatatatatgaaatcctagaaaaggcaaatacataggaaaaagcagatcagcagttgactggggctgatggtgggagaggggacttttgtgggggaagtgatagaaatgttttaaactggattgtggtgatgattacacagctctgtaaatttacaaaaagccattgaactgtatgcttaaaagtagtaaattttatggtatataaattacagcttaaaatattagtttgtttgggttgccattgtaactgcccaactggttcaccatgcctgctgcctagacagagcccatttatcaagataggggaattgtaatagagaaagagttattcacacaaagctggctgttcaggagaccagagttttaatattactcaaatcagtctcccacaaaactcaggaattgggttttttaagtataatttggtcggggggggagtgggttggaaagtggggagtgctgattggtcaggttggaaatcatagggagttgaagctgtcctcttgcactgaattgttcctgggtgggggccacaaggccagatgagccagtttgtcaatctgggtggtgccagctgatccattgagtacagggtctgcaaaatatctcaagcactgatgttaggttttcctttttttttttttttttttgagatagagtctcactctatcacccatgctggagtgcagtggcgtgatcttggctcactgcaacctccatctcctgggttcaagcgattctcctgcctcagcctcccaagtagctgggactacaggcgtgtgccaccacgcccggctaattttgtgtatttttagtgtagatggggtttcactgtgctggccaggatggtctcgatctcctgacctcatgatctgcccgccttgacctcccaaagtgctggtgttacaggtgtgagccactgtacctggtgatgttaggttttataatagtgatcttattcatccccaggagcaatttggggaggtttagaatcttgcagcctccagctatatgactcctaaaccataatcactaatcttgtggctaattcgttacttctgcaaaggcagtctagtccctaggcaggaaggggttgttttgggaaagggctagtatgtttttgtttcaaagtttaactatacactaagttcctcctgaagttagtttgacctatgcctcagaatgaacaaggacagcttggaggttagaagcaagatggagttggttaggtcagatctctttcactgtaataattttctcaattatgatttttgtaaagacgatttcaccataacaaaatactacagactgggtggcttaaacagaaattttttttctcacagttctggaggctggaagtccaaggtcaaggtgctggcagggttggtttctcctgaggcctctcttcttgtcttacagatgactaccctcttgctgcctcatcctctgtgcacactaattatagttattttgaacataaaatccttgtcatttataagattttagttcacaaattaggaagaaactgatagtcactatttgacttgttgacttaaattttaggctgatttatattttgttctgaacttttaatctataaaagtcatggttatttatgtattcttcccccccgagttcaaaccagctgcaagtttatttgaaatattaaaaaaaaaattatttaccttcctttattttgtatttgcaggactctgccctatggtaaactcactttttgtaacgctgatggtgggtgatagcacaaatgccatagaccatataatctagctgtattcttaaaaaaattttttttaaagtaattttggactcacaaaaagtcacaaaaatagtacagagagttcctgaatacccttttcacagctttccccgatgataacatcttatataacagtttgatataccttatcaaaaccaggattttaccttctgcaacatggtaaaacaagaacaaaaatgcaggaaatcagcattggcattgtgaaccccaaagtatctgagacaggtctcaatcaatttagaaagtttattttgccaaggttaaggatgtgcctgtgacagcctgaggaggtcctgacgacatgtgcccaaggtggtcggggtacagcttgctttcatacatttttagtgagacataatacatcaatcaatatatgtaagatgtacattggtttgatctggaaaggcgggccaacacaaagccggggagaggcttccaagtcacaggcagattcaaagattttctgattggcaattggttgaaggagttattatcaatataaaggaatgtctgggttatgataagggcttgtggagaccaacgttttatcatgcagatgcagcctccaggaagcaggcttcagacagaatagattgtaaatgtttcttatcagacttaaggtctgtgttgacgataatgctggtcaacttttcctgaattccaaaagggaggagggtataataaggaatgtctggttcccccttcccatcatggcctgaaactagtttttcaggctaacttgggaatgtccttggcctagaggagggatctgttcagatggctggggggcttagaattttatttttggtttacagtataatactattaactaaaccgcaaactttatttggatttcaccagtttttacatgcactcactttttcccccttagtttaacagtcctgtggaatcttatcccatatatagattcatgtaaccaccaccatgttcaggatacagaataactgtgttctttaggattttgctgtttgagtcctcatttattgaggtaaacttcattttaattcttaaaatcaactttattgaggtataatttatatgtaataaaatgagcctttttttttttttttttttttttttgagacagagtctcactctgttgcccaggctggagtgcaatggcgcggtctctgctcactgcaacctctacctcctgggttcatgcaattctcctgcctcagcctcccaagtagctgggattacaaacgcccgccagcacgcctggctaatttttgtatttttagtagagacggggtttcaccatgttggccaggctggtctcgagctgctgacctcgtgatctgcctgcctcagcctcccaaagcgctggcattacaggcatgagccaccacacctggccaaaatgagcctattttaagtatacaattccattagttgtgacaaatgtatgcatctgtgtaaccaccaccccagacaccgtctagacgtctctgttgcctcaggaggttcccttattcccccaattcgtttagccctttcccattgttctgacttctatcaccatagcttagtctttcatttttttctcagatttcagataaacggaatcttatggtgcatctgccctggaatctagcttactgtttgagatttaagatttgaggcgcagctttgacaatgtgtatataaacaaagtgtagcaaattcatgtaataatatactataacagatttctgggcattttacagtcctttttagtcctctggtttgatatccctttactttaaaacattctgcttcagttttttcaaattactcttctaacctccttcagaggttttaaaatactttaagatgttaataacaccacattattcaaagatatgaagaaatgcttatctccattcttttttcaatgttgtcccatttccttttcttttattccatctctctcaaccttcttgtcccttcccttctggtgttttttttttttaattttatttttatttttatttttttaccttttttctgttttcttttctcttttattggacttctgtctcttcatcctcattctctttactttcatccatttttattcatcttctattgtgagtgccctatttaactttcttcctttccttactttgtcttcgcctgtttctggccttgcagttgctgacttctcttcttaggagagtatcatcattgttgtcatcatcatcatcatcggttttttttttttttttttgagatggagtctcgctctgtcgcccaggctggagtgcagtggtgcaatctcagctcactgcaacctccacctctcggtttcaaatgattcttctgccttagcctcctgggtagctgggattacaggtgcacgccaccacacccagctaatttttatatattttttttagtatagatggggtttcaccatgttggtcaggctggtctggaactcctgacttcgtgatctgcctgcctcagcctcccaaagtgctaggattacaggtgtgagccactgtgcccagcccatcattgatattattattactagggcctttccccttcccctttcccctagggctggacccagggtatatatgtctctccaaatggagtgttgtctgaaattaactctgtgtgcagtgtctagggtgttctttggaaacatggcctgcctgcaatacctccttaatgagaggctctttggtatagtagaaagaacaaggcttttcagttagactgaggtttagaacctggatttaccatctattacctatttcatcctggccatgtttttaacctctcttagcctgaattccctcatctgtcaagtgggaataacaaaacccaccttagagttgccgtgagtatcaaatgggtaatgcatgtcaaatgcccaggtcatagtagtcacgaagaattatttccttacatggggtggggagagcagttttcctaggggaagtgaagcataagctgggactatcccaatgctcatttgtgctacaggattcttgcatttttctttgggaaaaattctgggattttccagaagaataaatttggagatgctaccactgagcccagtgagttctaaaaagcagctattaagctatcattgtattgctctttccaattgttctgggcaccatttatgttgaaattagggtagttcataaaatcatatattgtttaaacaaaagattttgtcatgtctcttctattttagcaaatttacttaatggtcttttaggaggaaaggtgataaataactaccttttaaattattttattttttcattattctgaactaatagcagtcagtaataggctgctacaactgtatttacatgcctattattcataactgtactcatagattttataccatgatcctctaggttctagaaatttcatgcaggtccttttatgtttagttgaaattgtacttcctttgcagtctaccatgttcccccctttttttggcttaaaatatgaaatatgttttgcatgcattttattatttctctttgattctacttgttgatatttttcattcagaatttcaaagcatttatttttgcatttatatttacatatcaaaaatatcatattttaatagttttacatattaaaactattttcagttctggtctacttggcttttacagtcagctttatgaattgaagctttggttcttatgggtaggtaatggagataatattattgtgtgttcccagctttctccttttccacataccctgcctgctaaacaaaaatttgtctttgctcactccacttttctccacctccatcctctaaggattcttctgactttttcagttgttcttatgctttgtgggatataggaaaggaagaagtggataggagggagagagagtatgagtgggagagcactgatggtgatgaaatgtgaaactcgtgagaatcgaaaaagagagaaaaggcttttttgggggagaagtgtggatgtgcagcataaattggatcacctttagattttccttggaggtctaagtgaagatgaaacaggattttcaattgctattagttgctgggccttttctttgaatatactaccatgctgagactaagccacactggcttattatttgagttacttctaaatgttaacttactaaatgatatatttttgtgtatgcttacacaaataagagaactgccattacccacccctctcccaacactgatcagttgacctaagtcctctcgtctccctctgaaatctccctttcatcagtctgcttctttccatggccactgctgccatcctagttcatctttcacctggagagtagcctccgttgaaggcatccctgccttcaatataattccctttctcaactgcccactctgctacagagttaactttctaaaatgtttagactcctttgacctcctttgcatggcttagggaccacctatattttggctcttgtacctttgtagtctcatctcctttgctcccccatcaccactcaacccttagccacacaaaatgacttgcagtaccccacataccgaacactcctatgctcccataactttgcacatgctgttcccctttgcagagaatgcccttcccttcttgtccacttactccgtctttcagcccattgaagacccatttcagatgttacctccaccatgatgccttctgcttaatactttcaggtgactggcaattccctctccttttggagcattttcataaacccttattactcttctctgtgtcctccactgagcaggagtgagtggagattttgtggcagttcagggcatagtggttaagcttgtggcctctgaggctaggcatcttgtgttcccagctgtctcattctcttactttgagactgtgtgtagattacttaacctcccaaatcttgaattctataaaatgagaatcacagtattacctactttattggtgttttgtgaggagtaaatgagataagagtataaaagtacttaatacaatgcctgacccattataagtacttaatcagtgttggctattttatttagctttgaattctcagagcttagcacaacgcctgacacatggaagacaacttggcaatatatacggagctacaatattattaagtctttcctaatggcttttagcttttatctccaatgcattatcattatttggaggtaccatactctgttttgcagttatttgcatatagtcttattccccttacttgactgtgtactctttgtagctggagagattgtcttattgagtgttgtatccacagcacagagctttgaacttagcaggtattctgtggctggtttggtttgtattattttccattagtaatggaagtacccattttgtgaccttggttggtgatgcacttgtgggaaataaataacatactttgggatcattaaaatcccattaaaatcatccaatgtactgggaggtccaatttattgggtaattactagaattatagaacaaattctttggactggaggagaacataaagggcatcatatccaagcatctttcttctgactcttttgcatggaatccagcttttaaaaaatattgcaaaatgatggcatgaaggagtgtttttgccttggttctcatattattcctgctaattttacacacacacacacacacacacacacacacacacacacacacacacgttgagtataccaaatctgaaaactttttgagtgctgacatgatgccacaagtggaaaattccacacctgccctcatgtgatgggtcacagtcaaaacacaagtgcacaacacagtttattcagcatcccaagggaagaaaaagcccttccaacccccttcacctacagtatagattctttgcacatgtccagattcccccaaacaagcatgcctacaaagtgtaataaaatggcacatgtgcaggctggatatgccaacggcacgttccccacaattccccgtgtaggaccaagaccttcgtgcattactcattgtgtatttttgcttattctctgctctgtggtgtaaagatattgttgaaaatgtcaaataggtctgaagatagccctatgggtaagaggaaggatttatgtgtatccatagcatagaaagtcaagctgtgggagaaactggacagcagtgtaactgtgaagcatcttacaggagagtatggtgttggagtgaccactatatatgacctgaagaaacagaatgataaacagttgaagttctatacaaaagtgatgtatagaggttattaatgaaaaatagaaaaacagtgcataaagctaaaaatgaaggtctcaaacatgtattgaaagagtgagtccatcagtatcacagtgaacacgtgccatttaatggtatgctgattatgaaacaagcaaagaaatggcaaaaattttgccattgctttcaatggcaaaaactgtaattatttttgcaccaacctataatagctgaaatggttctaaatcaaggtgatgatgaagatgacattgctaactgtaaaaaaaagtgcctatagatgatgtggtgaaattgtgatgggattattggatgactagagccatatgcatccataacagaacaagaaatcatgtcagttgataaaatcaggggcacttataagacaaaaacctctattaatgaggctgataactctggaggaaacatttaagaaagccatccagcagaatgcctcctcatctctagaggacctacttcctggtccctcaacttcttctgatgtttcttctcacctaaaaaaatagagtgtataaattagctgggcatggtggcacgtacctgtaatcccagctactcaggagactgaggcaggggaattgcttgaacctggaggtggaggttgcagtgagccgagatcgcaccactgctgcactccagcctgggcgacagagcgacactctgtctcaaaaaaaaaaaaaaaaagaaagaaaggaaaagaaatacctgagactaggtaatttataaagaggtttagttggttcatggttctgcaggctgtacaggaagcatggcacatctgcttctaaggaggcctcaggaagcttccaatcatggtagaaggcaaagggggagtgaggcacttcacatggctggagcaggaagaaaaggagtggggaggtgccacacacctttaaacaaccagatctcatgagaactcactatagtgaggacagtaccgagggggaaatccacccccttgatccaatcacctcccatcaggacccacctccaacattgggaattacaatttgacatgaaatttgggtgggtacacagatccaaaccatatcacatgtgaataagtgtaagaaaattattgcttatccaaagcatataaattcagtcaggaatgatgattatgccaaataaccacagattgtccatatgagtggctgagatagtgacacctttgctttctgatggttcaatgtacacaactttgtttcatgtgcaaaatcattaaaaatagtacataaaattatctttaggctatgtgtataaggtgtgtatgaaacataaatgaatttcttatttagacttgtgtcccatccccaggatatctcattatgtatatgcaaatatcccaaaatctgaaaaacatctgaaacactctgttctcaagaatttcggatatggggtaccgaacctacatatgtacatacatatgtgtttctgtgtgtgtgtgtgtatgtgataaatgaaaaatattataaaagataaaggaacaatcatatatgtatatatatacacacaaaaaaacacacatatatataattttttatatggtaggtgtttttcttttgtatttttcatattgaatgtcagttttcttgattcagtttataaaactccatgattagcaatgtgatttctgcaggatagggtgaccccctttcttctagtcctagtatcatttttccaggaagtctgattttaaacagtggtttggaatctcttctcttagtaatatcaagtgttttttaattgcttgcgcaatagactccataaggatgtgaagactattttagatatggttttgacagtattttcaagcttccagctttgcatcctacactgatttatatattattcagtatttttatacattcattttctctccaaagctgttatatatacataattttcttaattctttaaatagtgctgtggttatcactgtggttagcaagtgttgattttctaatttttgctgaaaggttaatcagtgaacaaagagcttaagtggtttgtaccagtgatgtagttaattagtgataaagctacgtgaacattctagcattctagccacttccctttccattttcatgcatcataaaatcatgtcttatgcagacaagtaaaactaaattttatgaatgcttatattgcccatacaggtgcattttatcttaaaccatagatttagtcatgaaaacttgagtatcgattataaataggtttatgatatttttgtaatacaaaaaaattctttggaagtcatccctctgtaatttatcttttttgttattcatttatgcaacttacctttattgaccatctcttatgttcaacatgctaaatgagattcaggtttgtataacttgagttttcttaaaataagatacgcctatataaacacagtatccataggaacataaatttatcaaaaaatgaagtgagaggaaaaaaataagaatttggagtgagattataacttgagcattggtatttagatgtacccccacctccacaatcccaattgaaatcactgcaaaattttaaaatgtggagaaactaaattcatgctggaggccagggaggtgttccaccttcatgttgcaaactttgaagagtttccacctgatatagtgcagatgggatgatactgaaagaatatacccaaacgaacttgcaatttcacttcccgagaaagtgacaagaatcgagttgggggttaggacaacctgtaggggtttccacatggtttactttcacaactattgatggcttaagagtgtcactaggagacccagaaatatagtcacactgaagtcaaagcaggccctgcattcgggcttttctctgatggaacaggcaacggcatacaaaggactggccactcttcctggagtggaggttgggtcaactcataaaatgtttatatggaaaattagaagtttttcctgctggggactacccatggttccagctcccttcctacttctcttgaccactctacatgaatttatattaaccagagaggaggtatctaagaacattaggatagatggtgaagggagtgaaagaaaacccacccacccaccctattttgtggaaaacaccagcctagatagactgctctttgttcaggaatgaacaaagaaacttaaggtttctgaaaagattctacaacataaatggagaacatagtattcaagaggcagaggaagaaaaatacttattttaaaagtatgttttctacagaaaaaaataagtatttttgataacaatgtgctttgtgtaaggaagtatataatacaaagtgagaagtaaaagcaaattaaaaatattattgaatgagactgcaggcaaaaagtcaaagggagattgctgaagaaggatgaaatgtgaggaatctaaaaatgcattatatgtagtaaagaaaagtattaaaactggggagaatgggatgagtgatggaaaaggtaaacttgagaaattctcctgaaatgcaatggaaaaagataacagagcaatgagatgatggcaggttggacagaggattgagctctaacatgcagacaattgttcctaaagaattaaagtctagattaaaagcaaccaaattgattaagcataccataagaaaacaatacaaacaaaagcaactttctggattacagaaagacgtagaccgggccgggtgccgaggctcacgcctgtaatcccagcactttgggaggccgaggcgggcggatcacgaggtcaggagttcgagaccagcctggccaacatggtgaaaccccatctctacaaaaaatacaaaaaattagctgggtgtagtggtgggtgcctgtaatcccagctattcgggaggctgaggcaggagaatcgcttgaacctggaaggtggaggttgcagtgagccgagattgcgccattgcactccagccctggcgacagagtgagtctctgtctcaaaaaaaaaaaaaaaaaaaaaagaaagaaaagaaagatgtagaccggcagataaaatacttattctgtaccagagaaaataaaaaagagatcaataattagatctaccctgacaaattttcaaggataaagcaaggaaattaccaagcatcaggatagaaaaagtaatttaaccctcaaaggcaaagttgacattggaattctcagcaatactaaatgccagaagacaatgaagccatgtctataacttttaggggaaaatgtgactcagaaaatctaaactcagccaaggtgttatcattagtgaaaacagcagtaagatctcagttatataatttatcactaatatgctatccacatacttttcctgaaaaagttgcttaattgctagtcaattaagagataaagcaaattaaacagttcaaccatggggaggtcatgaaataaaatgattagtggtgagtagtagaaagaaacatatataataggtcgtgaaatataaataaaattcaaaacataacataaacattttgagtatttattgaaagataaaagaataacaatcataaaatgagccccaaatccaagatagggatagaaaaaaaatatgaattatttagaagaatatgcaatttaacaggctatatggtcacaactatgtcaaggaaagacatcaacaacagtggggttctaggtaatagaaatgccatatactttttcctgctactctctatttccatatttttgtaatacgtttgtatttttatagtgtgtaaactttatcaaattaaatctatgtatacagcagagttataattacagacacatttgtagtattgactgctttgttattgctctccaaattaaaaataaactaagcatttagcttaagacattaaaaaatacacaataaaacagacatcagagaacaaaaagaaaaataaatttcaaagcacaattttttgtatcagtaaacaatagttttgaaaaagcacatgccgtctgagttgagtatttaaaacaaacagaattaaacctaaacaaaaaatacagaaaacaatgtatttaaatcataaactcagagaaagtaaaatgtatagctatgctaactatgaagtgaatagtattaattagcaaaattgacttaagtacaatgctggaattggccaatatatggaaatattagagaaaactgccaaagagctactccaaatgttagtgattgtctctaagtgggtagcattatgggctattttactccctctttgtgtgtttttttttttaatttttactttttacttttttccccactacaagctactttaattctttgaacaatttttccatgcgggtaaactgttaccatattttcctattaagaaatattttcaatagattttttttctacaataaattttactggaaacatttggttcattaatttttgtctatatgaatgctgtccatcatggcttttgacaatctgagttttttttgatgatcacatttctaccaaaatcaattttcctaagtcaaattttgtatatccagattttgtaaatatttgactcttctattgatttttaaaaaatcaattttaccatgtgcatttttccttctgttgcttttattttgtttgggtttttaaaaaatcacgtttatttttttgcttgtctcaaaaatttttaataagcaggtatgaattttgaagttagatatgaataaaaaccaactgaaaaagcaaatccctctgtctcccaagacaaagtgggcagtttgtttcttttgagctttaaaggtagaaatagctgcctttctaaaatttaagtgaagcgaaatgttgacatgccctgaaaggactgccaaggttcagggagcctgttaatgggccttgagaggctctgtgactctggactaatggcccagggaccactaagagtaaattgaatttctagattactggctactttcacagctctctgatgcctccaggatgggagagtagacacaccaaatgccagaaaaataaatgctaaataataattcttcgaggttcaatggaatatctatcacttaagtagcaaactatttactaagtgtcccaaattttgcacatttgcattgcaagattttactagtaacatgagtaagtgaactgttctttacctcactcatggaataagtaaatgaaggttgtgctttttgatttaggccactcttgatatactacactcagaactacattgctcactccccttcctaaagaaataaaggtgaattgcaacaaggttctctcctgcatgttagaaacactgcagagtataatacttgcatttgccacacagaaatgcagggagagaggagcaggttggaaaagtagttttctcatctaaaattaaaaaaaatttttttgatagaaaaattttttttgaaaggaaaactcattgtgtgtatatcttgcttaccttgttgagtgtatacttacattttttatttaaaaaatttttttttagaaacgaggtttcactatgttgcctaggctagtttcaaactcctgggctcaagtgatccactcacttcggcctcccaaagtgctgggattacaggcgtgagccactgcgcccggcctatttttcattaaaaaacttttttttttttttttttttttttttttagagatgggagtttcactctgttgccaggctggagtgcagtggtgtgattatagctcactgcagcctgagactcctggattcaagtgatcctcccacctcagcctcccaagtagctggaattacaggtgtgtgccaccacacccggctgttgttttgttgtttttattttttttttgtagagacgaggtttcactatgttgcccaggctggtcttgaattcctgggctcaagtgatccgctcgcctcggcctcccaaagtgctggaatgacaggcgtgagccaccatgcccggccgatttttaaatttttttaaatagaattcctataatatacaaatataatacacaaatcacctacctcacttttaaaattctacatttttttaaagacaagtaggagggtgactttattcaccaagcgatcaaaagcaggctgcagaggacagggatttagattgggaaactctttgtattctatcaagctgtcttctttactggctaccttaaggcatttttgctgggaagaaaaaccttaataacatcaagggcagtttaccttaaccctcctgccatcccattgtaccccaccctaccagccagaaacagaagtcttacgaaaaggttttgaggaaaatatcctgtcctagtttactccgttccaacgaattcttcaaacacatccttgacccaggacatacgcagagttcaaatctagtctgtatgttttgttaggctaccggtctcctttcttgggaagactcctgactgtgccttttctgtttaaagatggtagaggcgatgggtgttctcccgcaagacggtcaaggtgtgggagagcgacacacctttgattctggcaatctctcgcacagtatgcagggccaggcctgggtgggcatactggcaatagcttttgggaacccagcgagggaggaagaagggagcatcggtttctacaataattctctctagcgggatctttctcacagtttctcgggcttgcccagcagaagagtaagtcagaattgccgtgaagcccacatacaggttgggaaagtggttcaacaggggctcgatgactgagtaactcccagtgaagcaatggcgatgtatcttgtggtcagagggcacgtaatttttcaagatgtgcagtaggtcttcatcggcttctcggcagtggatcatcatgggcttctttagagagacggccagccgcagcagtctcttaaatactttctgctgctctgggatatgcgtggtgcacttactggagtaatccaagcccatttcgccgaatgccacagccttggggtgtcgtaaggcttttaaaatacttctttcttgatagttgttataataatgggcaaaatgagggcgacagccaaagaccccccaaaccagatcatctttcaactgatcctcccacaggttatcacttaggttttgaggattgcagaagcaagaaatgcagccctgaaactccttggggaaggtgttgctataaatttttctgaatttggtaaaggtgcctttgaaaggcagcctggaatatagcaagtctaaatgacagtgggtatcaatgaaacccggttgctctggctgccagatggtccttggcggaaagctagatgcacgtcctccataaggatgtcctaatgtctcctcttgatatactctctcctccttcgcctctgcttccacatttctggagtagtaaaataaggaagaattcttggatctgccttcctctgtcatcttcagatctctggatgtgttttcggagctcactggaaaactggtggaataatcactcaggaagctctggtggctgctcctctcaccctggaatatgttgttgttgcttctgctgctgctgctacagctgctcttcccagcctgcaatgtgttactgctgctgcccaaggagggatagcaagaagacttggtactgctgaaccaagagctggtgtagtcatgccaaggactataatgaggtggaaaagtggtgtagtcagtggcgtagtatggaggctctgacactacaggaagacacagtgagaatggcttctcttcagagaatatgactgtggttccacctacatcagaccagtcactccctgaagaggggcgctcaattgccatcttttctttgtgcttttgaattactgaatgggagttatagttatccggaacatttaaaggtggagagcttttttcacaaatgactctactttggttgctaagtcgcttttggattattacatgggggttatagtcatccagaaaatttgaaggctgagagcatttttcacaaatgagtgtattttgtgttttaggtcgcccctcactgaatttctcaggaggattaacagtcaccctcttgtcacaggagctgctcatttctggggctgactctttctctttttgaggagcaaagatagtggcattcctggctggtctttctccacagtagggacactctcctaggtctgattgtgaactaatgacagcctcttcctttacttttggaatgtcatctcccaggatctcctggagaacactcagagacaatgaagagccactatcttgaggtctacccttcctgctctggaacttgtttggttcctcagtttcattttgaccctcacttccagctgtaaattgagggttcatggaattataggagctacgtttggaattaattttaaggctgtagataccctcctccagagaagccatttctttaaaaacggggctggcagagtgcactggggatcacaaggacgaaaggaactccaaatgctccaaatgaggcagtctttggagccggccctaatcaggccagtggctgaggaatgggaggagaaggaggagaaagaatttctgtggcaggatgaaccttgagaaaaacacggtgtgcaggccacaaagtagcctttaggcctttcaggcctttggggcctctctccccttccaaaccacgttactgagctccgcggggcacctgtgtttgctgcaaaccacgttactgagctctgcggggcacctgtgtttgctgggggatcctacctaagtgccgctccggtggtacttttctgcgtgccgacgggccccagagctggagggccctcacgccactccggcgcctccttttttcaactgtctatcacagttctcggtgttctagagatgccaaagcccttccacaattatttcaaagtgctctggagaagtcctaaggatccaggcctggtatggcgtccgagcccggaacgtactcctaagactgtcccaaatggtctgattttgcgctgtgcaacttcccggatgtaaaaaaaaaaaaaaaaaaaaggtacttccgtggagtcaaagtgtttccggggagtcaaagtggcctggtatggcgtccgagcccggaacgcactcctaagactgtcccaaatggtctgattttgcgctgtgcaacttcccggatgtaaaaaaaaaaaaaaaaaggtacttccgtggagtcaaagtgcttccggggagtcaaagtgcttccgatcggccgtgcgccgtggcttacgcctgtaatcccagcactttgggaggccgaggtgggcggatcacgaggtcaggagatagagaccatcctggctaacacggtgaaaccccgtctctactaaaaatacaaaaaattagctgggtgtggtggcgggcacctgtagtcccagctactcgggaggctgagccaggagaatggcgtgaacctgggaggcagagcttgcagtgagctgagatcgtaccactgcactccagcctgggggacagagccagactctgtctcaaaaacaaacaaagtgcttccgatcaaaactcttacttttggtttggaatacaaggccctttggagatgtcagagtccatgaaatgactacaagacaccttagggatcagacacagggtgcccctgggtgggcttctggcctagatgccctgatccccaacggccagctggaggacagggcagaacatactgtagaagccgagtcgggaagcctgcccagcccccatcacctcgcctgccagcctgggtcaggccagcagcccgctccatctaagagcaacactcacctccccacggccatccagcccctcctttaccacgcctcttctcactgcccagccacgtgtctacccgagctgcagccattacatgctttttgttcctcccctccaccctcagtttcttccaaaagcgtagtcatggtttttagagcatagtttaaaaacatagttttaaaaaacatagttatgactgtggtatataacaattttcagtcttgtggtgttttttttttgtttttgtttttttctttgtcctcctctcccacccccccacccccccccaccccccccccccccccgccccgagagggagtctcactctgtcgcccaggctggattgcagtagtgcgatctcggctcgttgcaacctccacctcctgggttcaagtgattctcctgcctgtgcctcccaagtagctgggactacaggctcgtgccaccatgccaggctaaattttgtatttttttttttttttttagtagagacggggtttcaccatgttggccaggctggtctccaactcctaatctcaggtgttccacctgcctcggcctcccaaagtgctgggattacaggtgtgagccaccgtgcccggcccagtcctgtgttttagtcacttaacattactgtatagcctcagtatttttcttattgcctcatgtttttcaaaaatatcatgctggtgcctttataatactccatggagaacgtagatgtgccgtaattcaccaagcccttccctttttgttaacttttcaggtccccttattctacctttttttttctatgataaaaagctgcaaagaacatctttgcacatacaagtttcttctgtattttgggttgtttctttggactacgtgcggggaaatggagttcctgagaggaggtaggaattttaaattggttcctcataacattacattgccgcagaaaattgtactaacttaaaatctcatccgtaatgagtggtccatttaataggagaaacacacacataaaccctatgcctcgttgttattttaatttgcacttaatctgacagtttcttagagtgaacttctttttatttgttgaccctctcatgaattttgtttatgctgttttcccatttctcttttagggtctttaaaaaattaaacatttttataaaattaaagtttagccatattttctaaaatgttttgttagcatgtttttgtttatattttagtatatcggagttataacttatgtagttaaatcttaatttttaaaaatgttttctttctctttttctcccaagcctgcaatgtcattcctccttctgaggcttgacacatatttatttttttggaaggtgaaaggaattgatttattatatttaagccaatacttcatctgatatttgggttggattttacaggaaggaggctatacactgatgcttttccaagttggtactttttttgcttattgatatgtgactcctctttcattatgtgttaaattcctgttaacagagtctatttccagggcatctgttcttttacacctactatgtctcttgttactgtggtattgtactactttaataaatgaactattatattaaggtataaagtctgggagagctagatttccttcattacacttaaattttacaactatctttaataggctgaactatttatcaggtagacttaaaaaaataattctaggccaggcccggtggctcacgcctgtaatcccagcactttgggaggctgaggcgggtggatcacctgaggtcaggagtttgagaccagcctggccaacatggtgaaactctgtctctactaaaaatacaaaaattagccaggcgtggaggtgtgcccctgtagtcccagctactcgggaggctgaggcaggagaatcacttgaacccgggaggcagaggttgcagtgagtccagatcacaccactgcactccagcctgggtgacagagtgagacttcatctaaaaaaaaaataataattctaagtccctccagaatgacattgaaatacccacttgaaaagttattttagtctgcttatccagaatatacttcgcctatccttttagtcaagctcttctattaatatatcttctagtaaatatttttagagttttatctgggtcacagagtttttattaaaactatttttaagtattttgtaattttgtattatgaacatactttccccccattgtatggtctagctggttattgctaacacataagaatattttaaattcaggtatggttgtactgaaatctttgttagtttttcagcctttgcctaggtcattattttatctacccataatgataatttttgtctctttcttgctaatatttttacttcatatctttctacgttgtccagagcttttaaaaacaatattaaataatgatgctagtaggggcattattgttctattcctgattttggtaggcacatagtttaattaagtattatgttagatatttaggctgttgttttaaagcagatctttttgtaatcttgttaaggaactacccttgcatttaaaaatgtatgtggtaggaaatggtgtgagatcattatatatttgctcatatttcctaattgggaaacatgttggcatctgtgagtaaaatgctgttttttttttgtgtaggtggcttgtaactgttacagactattaaattctgtttgcttgtattttacttaggatcttctgtaaatcataagtagtgaaattgttctgtagcagtagttctcaaccttggcttgcagtttgtaatcacttggggagctttaaaaattactgatgcctaggcccaccctgagagaatctgatttctgtgtgtgtgtgtgtgtgtgtgtgtgtgtgtgtgtgtatgggggatggtggatgtctgtggcgggggttggggggctggtggtggacagtgtggccaatgcatcaggatttttaaaagctctataggtgattctaatgtgtagccagggtgagaactattgttttacagttacttttttttcatggtacgtctattaggcataggaattcacctttgtagctttccatcatttttggtatcctggagagttatataatttggtaattttcttttccttgaaagttggaacaaattcattagtaaatcatcctggttggagactttattggggcaattctttggtaatttttttcactgcttacttggttattagcttattcattgtgtttttgataagtcacggttcttacagaatatcacttatttaattgcaattttaaaattcattttcatatgtttgcatgattattataagataatttatcttatggtttatatcttataattgcatctctgtcatgcactgtatcatttctcattttatttatatttttcttgatgagctttctaaaatcttatctattttatttatttaaaaagtccttggatttatttattgcagttgtttttcttctttcaaatttatatatccttactatcttttttgctttctgtttttcttatgacaaatttttgctttttcaaaaccttttgtttattgttttgaggcagtctcattctttcgcccaggctggagtgcagtggcacgatcatggctcactgcaacctctgcctcctgtgttcaagcaattctcctgcctcagcctcctgagtagctgggattacaggcatgcaccaccaggcccagctaatttttttgtatttttagtagagacggggtttcaccatgttggccaggctggacttgaactcctgacctcaggtgatctgcccgccttggccttccaaagtgctgggattacaggcgtgagctactgcgcccggccttaaaagcttttgtttgaatcattgctcactggttctaaactctggctatgtttcagaattacctggggagagtaggaaagaaaaagaaggatcttgtacttgcctatctcaaagttcatggctgagacctctataacaaaagacagattaacaagagaaaagcacacaaatttatttaatgaaagcttcaggagacatggagccttcagaaatgatccaaagaaacaggaaaaactatttttatggacagtcatgtagaactgtgactggaggacaaaaggatatgatctaatggtaataaactggggggaacttataatagcaagatttgtttgttccgatttttattcttcatccttatgtgacactcctttcctctgggtatagggcaggacacctgtcacatgcgagtctatagggaaggaggaagggagaaggtcagagaatgaccttcctaggtgttatgacctgcctccggggagaatgatggaagaaggtcagagagaccttcctgcttctgcctttttctcaaatgccaaggtgccatgtgcctcggcatatttgccgaggtagcatgtcctgaaccccatcagtagcttttaaaaaatagtaatagtcccctccccaaggttctgatttaacttacttaggcaagggtctgggttttttgtttgtttgtttttcacggaatgtcactctgtcgttgctcaggctggagtgcagtggcgtaatcttggctcactgcaacctccacctcccaggctcaagtgattctcctgcctcagcctcctgagtagctgggattacaggtgtccaccaccgtgcctggctattttttgtgtttttagtagagattgggttttgccatgttggccaggctggtctccaactcctgacctcaggttatccactcaccttggcctcccaaagtgttgggattacaggtgtgagccattgcgcccggccagatctggtctttcaaattttttttaaagttcccaatgcatagccaaggctgagaaacactgttagcaatttatcctctctctcagactctaaattcttttatgtaataattttaatccattaatttaccccagattgcaaatttgcctatatcctataggtttgtatggccttatattttattatatacttttatataaatttattacatacatgtatataaattttatttgtatattttttatatttttagatttatttttggtacaattatgaggagtgacaattttcgtttataggtacattatacacttctagttgtattactttgtgatcagtgaatataacttgtataatttttctgtttttaaaatttattaaaatttttgtgaattagcatatgtttcagatatatttctgtaaatatatatattgtcatgtataaaggagccatcctctatatgcaacacaaaatgtattatcgtttatttccttgattatgggacttcataatcatgagagaaaccattgatttaataacagctttttcaggaagaataaacaacactgtattaaatgtacacaaatttttcttgtctactaacatatagagcatgcatttatccttaccattatatcccttttatagtacttcacaatttaagtctgaacctttttcataaaacagagcttaaacatattaaacttggacatgtgatgttgacctctttataaaatgttgaggttattgaacattgccgatgttttgtctttctttcctgacagcttctctagaaattcagctgtaagatttttttttttttttttttttttgagctggagtctcgctctgtcgcccaggctggagtgcagtggcgcaatctctgctcactgcaagctctgcctcccaggttcatgccattctcctgcctcaccctcccgagtagctgggactacgggcacccgcccccacacctggctaattttttgtatttttagtagagacagcgtttcaccgtgttagccaggatggtctcgatctcctgacctcgtgatccgcccgcctcggcctccgaaatgctgggattataggcgtgagtcaccgtgcccggcctcagctgtaagtttttgacattagatgtttgattcctgaagtgatagtctttctgactcacgtattggccacatcagcctccccatctttaaaaattatatgctttattctaagaaattaggcttttgcctttgccttacagttgcatggtctagcctgcaatggacaaccttctccacgcaattattttttgtgtcatactgcatcagacaataatcattttcaaacattttaagtgaaaattaagaatctaatgttaaaatccagctgtttgggatatgcaatgctaagcaaataactcaactgtcatgaagataggatagattcttctctacaaagctaaatttgcaccatatatcaagttagaactacttcccatcaaaatgcattcttgactgctttgagattcttttggctttaattgtaagaagatcctgaattcagaaacattaacatttaaaatttttcctttgtaatgaggaaatcatatacctgttatttaaagctaattgatttcagatttcaggagttttttctttttcttttttattttcttttctgtttttctgtcacccaagctggaatgcagtggcatgatcatagcccagtgcagccttaaattcctgggctaaagcaatcctcctgcctcagcttcctgagcagcttggactatgaggcacgcaccaccatacctgactagttaaataaagaaaaattgttggagagacagggacccatgtgtcacccaggctggtctagaactcttggcctaaagtgtttcaatcctcctgatgtagcctcctaacgtgttgggattacaggcatgatccactgtgcctggtctaaggttttatatcctctaggctaagattaaaattccaaatgccttgaggatcaggtaggtaacctcatataatatcatagggcctgcagagccagagaggcctgtggaggactgaagatcacatgcccccaccaaatgatatttatattccgttttcaagaaaattgcagccaattacatcctctaggaccttatttttcttttttcttttttttttttttgagatggcgtctcactctatcacccaggctggagtgcagtggcaccatctcggctcactgcaacctccacctcccgggttcaagcgattctcctgcctcagcctcttgagtagctgggattacaagcatgtgccagcacgcacggctaatttttgtatttttagtagagacggggtttctccatattggtcaggctggtctcgaacccctgacctcaagtgatccacctgcgtcggcttcccaaagtgctgggattacaggtgtgagccatcatgcccggcctaggaccttatttatctagtttctgcttgacatcataaatgatgataacaccttacatcataattatgttcctataaattttcatttttaacagtttttattttaggttctgttttctggattctctgatacatcaagttccattgcaattagatcatttatttttgtgagatcactttttaatctatttggtgtctctcctcttacattctacttcaccacattttataatttcctcttcctcttccttttttatctttccatctctacctcattctgacttgctctgtatctttcatgctggagtttgacagccctgtattctcatgggagcagactatgaaatatcagtctgtccctcatctagacatattgaagcccaacctaagataatgtctttccttttctctttatttcaatttagcatccttctcttttaatgcatcatttgattgataaatatttaatgattacatacatgacagttgacctatgccagttgtcaattgacctatgccagtgtagtcattctcaaatttatactggcagcattcagtatatagaggtgggtgacagccaagaatattctctctacactttcctacttgattacaaagaaaaaaaaatctcagattaaatattacgtacactgaaagtttgatgaagccccagctctttctccttttaggtgttccaacatctttttttcctcctccttttttaaaaaaaattatttttgagacacagagtctcgttctctcacccaggctggagtgcagtggcgaggtcataactcactgcagcctcgatctcctgggctcaagcaatcctcccacctcagcctccctagtagctgagactacaagtacacgtaaccaagcccgactaatttttaaatttttttttgtaaaaacggggtctcattatgttgcccaggctggtctcaaactcctgggctcaagtgatcttcctgccacaggcctgagccactgtagccagctccctccccctactttttaaaagttgaaatataattcacataacaaaaactcaccattttaaagtgtccaacacaactcagtgtctaatatctttttttaactgaggtaaaattcacataacatgaaattaaccattagccattttaaagtgtgcaattcagtgacatttaacatatccacaaggctgtgcaaccatcacatctatctagttccaagacttttttgtcaccccagaaggaaactctatacttgtccaacagcatcttatctgaaatattcactcaatacaaatgtgacagcattctagcaatggggtttagctaacctaattggagtcaggccagacaaattctttaagaaagcagctgaacataggactatttgggaatgaagccaaaggtgccatcctgaagggagtagatctctgggttcaccagactcttataacctgttcctgtaaggacagtgcctggttagtatttgtaactgatatgtgcattttgaatacaatcatttcactaaaatttattctaatatcatttatggcaattgacaaagcttcttgtgttgatcaaagaaaaagctactgaggcattctgttagccacttctgaagtgtgggcttctgataaaaatatgctaaacactcctggagtatatattcttacttaggttaactgaccaccacccctagagggtagattgcatctaacagactcactcatatatatcatattgtccacattgaataaccctggagttacatcatatgcacagttaagttttgcaacttcaattataaaaattgatcaaaagtgagagacaaagagaatatttaaatggagctctcacagagcttgagccgcaggtcaagcttgaaatggtagcctgaatctacttttcccacagttgtcctcaattaccttgtcgtgctcagtgtgtgagcaggatgccatattaagaatgtttccaatggctaaagatatatattattcatacaacatggcacctaagcataaagaaatgattttaactggtcttcaactgaagaagcaggcagtcatctgcttcaatatgggagaaaaatgggctgtgttttacttactgagaggcacagttttctaaagtagttaaggaattttcaaagatatttttgactatctctgaattttaccataactgctttagaatccacctgtccttcccttccttattccctaccgcccccatacaagatgagtctgagtctagcattgggctaggctccttgaggttcccgaagtgtaaggtggggtctccagggcattggatgaatttcagatatgcctgcttgaattgcctgaaggcaagcaatcatcaggactaacagtcaggataattttatgccagaaccaaggcagctttgtgttattgttaatgggaaaaaaatgacaaaacttattcatcttgtgagaaagaatattttgtctctataacatatacatttagaatcccactgtgaaatcccaaaggcagactctagttcagtttatggtagagctgaacgatggatgtattacttgaatatcatttccttgttttaaccagatggtgataaaagtattaaataatctttatgtattgtatcttagattgtatatccattcgcatggctgatgtgtagaatgagttcttggaaaaattctctctacttttttctttatattaacaaaaagtatacaggcagctgctttgttaattttaagtttgctgaattttcttttcatttcttagtttctaattattattccaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaaggtatctatttaaagcagagttatggttccttcacttctgactcctgcctttatatactgcctgcctttagcttttcaaaagactgcatgctactgtttaggctgtctaacctgctggcagtggtgaatataaacatgccattagcgtgtagttattgattgtgacttaccagctttctaccctctgcatgtcaacattggctgggtctctcactcctccgtggcatacttgtatcctttcaggtgctgctctggtatgagtaaactctcctgtgcctttgactttttcctcaaaccctttggtcgccttgccgtgagcagatcacttccttcacaacaccattaggggagaagagaaagctgttctctactgcagcttccagattggcattctcttctttcttgaatttactgtcatttgtttcaaccaccccctcctcatcctcatacctgttaactacagacttcgatggtacctcaccagagagtcattgttccttcaccctgtgtatgccagtcatctttgtccatactcctctcagccacagataagagttaactctgtgatgtggccaccagagaagctaatcctaggttgcattaagtatggcagagatcaatggagatgactgatttcttctgtttgtgctgtgggtccttctcttgggatgctgcggagttctgaatgacttcaggggacagcaactatgacggtgaaagaactgaacatttgtcatgtgcaagacagaatagtgaaaagggatatttgtctgtaatggggagactccagtgtgcttgataaatgtcctcaggaatctaaagggctgtcatgtggagaaggggtgaccttattctctttatgttcatggatgggacctaggggtcagagttcaggtcagtaagaggaagaactttctggcagagagctgctagaagttatagggaatggacctgggtagggttggggttaggggtctggtgtaggggcggaggagaggagagtcacagatttgtttgttccctcgtgtagatagatggccctgggggcaggtcaggggtggtttttcactgacagcctgctggaagtatgagaggatttgagtgtttgtttggttgctggtgtaaatgacctttcagggtactcagttccttgacgagctgattcttgggtgtgttgttgtttctttgccttttagagtattgccacctccagtatctcagtctctgaaattgtcttctctaactacaatatatactccttttactttccctacttgctcataactaccatccctgttcttcactctcctagaaaaacatatcctgaatatgtccatgtctttccatccccttcactaccatcctcacctaagctaccctcatctgttgactagaggaatagaatagctgcctaacgtggtctccctgtttccattcttgctcctcctacaatctgttctgtatgcagcagggagagtgttgtgtgggatgttacctggatacagtggtggcctttgagaattgtacatgcaggctctcccagaggtcacaaaacagaaggctcatggatcacattaaaatgcatgaatcacatgttacattaaagtaatttaaaacacatgatgagaagaaagagggaaagagatagggtaggttcacacacttgggacagggtacaagtaggcagaaggaccatactgcctgaatcctggggtcagcaatggttctgtctctgtttcactaaccttccctgctactagtatggtttagagaccagaactgaggttcaagcaaggagaaccacagacagaaggggcttcgggctgagggcacacacttgctctgttggggagatgcagggagaagtgtgcctggccatggctgtagcttgtcaataagcctgctggatagtcttgggttttgtttgtgtttcttgggcagaggtcacatggggctagaatgggtgtcaccgatgaatgagtggccaaattgaggcctcataaatattgggtgctcatgaatatttagtgtccttatatatttagcatatcatgaatatttagagtccaggtgcctcatgtatatttacgacctactgaaaatcagttatcttttggtttttccatccctttctttctatgtttaacatgcccatgctctacttagcatacctacctacctattgttatttaacacatctcatgatttctgcctatgctgaacaaattttgcttactaattactaatctaggcctgagggctctgtattgatataccacaatgagttcaagggggagaagcagggatttgagggccatgggctctgagaataaggttgtcatgcaacctcattaagtgtgcagaggacttccttcaatgctcatgagattgaggtttttcttagagcatggcttcattgtgtctggtggttggaataatgaatttggagccagccagcattgccaagaagtatttgttggatgcctattctgtgtcaggcactgtgctatgttttgggaaaatggacaaaaggactgagtcccatcatagccctatctcatggagtaataataggccaccagattggaaaggaaagggagcaaggccaccagtccaagagttttgcaattgttcaggctagaaatgctgagtgtccaaaccaggacaatgatggtaggaatagaaaattggggaaggatttgagagacatttggttggcagagttgatatgcattggccagtgattaaatacagagagtgaggagggggaatatctaatgaaaaagtgcctaccttatcattatctcatttaatctcctgatgaccatctaaagtagttactgtcactgtcagcttttacagaaaaggaaacaggcttagggaggtaatttgctcagtctgttttgcattgctctaaaggaatacctggggctgggtaatttataaagaaaagaggattatgtggctcacagttctgcagactgtacaagaagcatggcaccagcttctgcatctggtgaggcctcaggaagcttttactcgtggtggaaggtgaaaggagagcaggcgtgtcacatggcaagacggggagcaagagagaaaggaggggatgccagactcttgttaacaatcagattttacggtaaccaacagaaagaactcacacattactgcgaagacaacacaaagacattcatgtgggatccacccccatgacccaaacacctcccagcaggccccatctccaacactggggatcacatttcagcatgagatttggaggggacaaatatccaaactatatcggcctcagaggtctctgtggttgagtcatgatacctttataaagcccaggagcacagagcaagaaacaggattggggtttgaatctggggtgtgtttcagggcatgaggcctttgaaggggtgttagacatctgtgtggtgatgcccctccaggcaggtacaaacttaggatgtgttttcaggaaaaaagtcaagactagaaatggagattgggaatcagaggtgcccagatcatgaccaggctattctaccatgttagaggagagccactggtgaggtgatggaaagataaagggaattcaatttagtgtctctgcttggttttactagtggtgggaaaagacgaagattagtatgaggaggtaatatgaactgtcctcattgttctttgtgttccaactgatacactatccactccctggccattttatttggtgaatttggcctaatggtaaatctttcaggaaatatggaaataccataacattttaaaaacaggttttcacaaattttaaggttaaaagtatgacattttattttacaaagggacaagaggttttagattctttagggtcatttaaaacatataaggcagtttttaaagattggcaagaatgcattagaaaatggttgaagattatttaagaacaaagaatttacaatttataatttttgtggacatctattttacttacgtgtatttgattatataatagtattgctgtggcaaaaagaaaaaatttcttacaggttttcacctaaacattttgttctgatattccctcactaagctctgcttattttctgattactttcccaccatgacaccaaacttgcacaaatgatagactggaggtcacaggacaccccaggcctgggttagtgacttgcattattgttttcattattacctttaaagtgaaagctcataatcctatagctcactggcccctgtccagttcatcttagttttattaaactatccaagaagaaatatgaaatgtagcttcttttagaatcttggaaaggcttttattaagacttctcaattctttcagactcttgatttcaaatctcacataggcagattccaaaggcaagctgaagatagtcataatgatgtacttgaaaatcattcttgtgtaaggagggaggaatgctatcataaagtctcagaaaaaaaagacctgagtaaaagacaactttaaagtctctggaaattttccgaatttttgattggctcactgtggtcaggacatttccctgtgtgaagacacagctcaagagttgtgtatagaatacacagtaatcacgctgcgtaatgacattgaatttgtcagcagagtagagaaatttggaaggctgtagcaaatcctgtagaaagcaaacatgaataaccactctgtcaccaagctttgtttagagagaaaccagtctcttgaaatatttaatatgataattcttgttaaggaaggtctatttggactgcagatagtttgaaaaatcatttaaatgccttcttcaagcttttctaaattaagtgattggaaaaaagaaaacacttaatgagccagtggttcagacgtcagtgggacagggtaggtagtgtttctttcagttgtgacttgagtggcccgggcttgctttccatgcatctgggccctgggaagaggcaaatggtcaagattaggtgctgtgcagtgatggcgttcctgtcacttccataggattttgatattttctagatgaacttggaggtcagatgcacttgtttcttgtgtgaccatttggaaattagtgcaactggaggaattataaccctcccctgctcccttttggttgcctctattatcatgtaattttttagggtggggggagtttggaatcagccagaaacaaaagaggcatccattagcatggtaccaaaataggcattcatgcagcttctaatcagaacaacatatttttaatattcacaagttcttgttggcaaggagatttgtgtgtgttatgagtcaagaaagccagtattgcacttcaaggcttgctttcatttcttgccaggacatcactctcttttcggttagatgtgttatatttacagaacgtgttgcttttctgctggaatgtagttaaaacaacattatatcaagccaagaatgtcagaggttaatccagtagttttacctctaattgtctaacagaataattgtcagttaaatacaccaagtccagcctaatctgtgctaaagaaaggataatgattagaaatgtgccgtgattttctggtatggtctataccagttgttctcagttgaaagtgatcctcagaatctcctagcccaccccagaattttttcttctgtagacatggggtcaagaactggcttccctatgattcttagtgcatcttggttgagaacactgatttccactaatgacttgttttggccccttaataaggtagtatttctcatatatatattttttaatactctaagataatctgcttgatcaggcaaatgtaatcacacaaaatagaagtcagtcattcatatgccattcactcttattgggcatgtactatatataggtattatatcccataaagtggtggaggggtggtgggaaggttgccagatgaagtataagatactcagttatatttgaatttcaggtaagcaatgaagtttttagtataattatgtcccaaatattgcataggacatagttatactaaagaatttggctgggcatggtggcttacacctgtaatcccagcactttgggaggcagaggcgggctgataacttgaggccgggagtttgagaccagcctgaccaacatagcaaaacctcgtcgactaaaaatataaaaattagctgggtgtggtggcacatgcctataatcctagctactcaggaggctaagacaggagaattgcttgaacctgggagacggaggttgcagtgagccgagatcacaccactgcactccagcctgggtgaaaaaaaattaaaaaaatttaaaaaaaaaaagaattctttgttgtttatctggaattcaaatttaactgagcagcctatattttaatttgctaaatctggtcaccctagagggtggacactggggagagaaccaggtacttgagggattagaggaggaaaagccaatatccactagagaatctggcatttgaatggtacctcaaaagtttctctagataaagatggaagagaaaggcagaatagtcaaaaggagcaacatgagataaagtggtgggacaataaattgggaagtatttgggagcagatcatagattgaatagggaaaacagggcaagaaggtggtcatgcaagaggacattaaagcatctgttattttggtgctttttcaatagctaagggggagatgcgtagggttactgtttcttattgtgagcagaaatgtggaatttttaacttcttattcttttgctgcaaggtgagtgcccggttgtgtatataaaaataattattcttgtgaaaccgaaactctaaaggtgacattttagaaaaataaaagtaaaagtatacaagtcattttagtagaggaatatagtaagcacaagaggaagaaaagacactctgttatgtgtgattgtggttaagcctcttagtatttttagggcacaaacttgtagatgtgatgataagtggcaattgcagttatatcttcatttacctaagaaatatctgcctttagacttggatgtactctaggcctgcagcattactaaaatgaaattaacatacttaaattaaaatagaggtgacccaggtgcagtggctcacgcctgtaatcccagcactttgtgaggccgaggcaaaaggattgcttaagtccaggagttcaagaccagcctgggcaacaaagcaaggctgtctctacaaaaaataaaaagttagccaggcgtggtggccatgcccgtaatctcagctacacgggaggttgaggtagggaggatcgcttgagcctgggaggttgaggctgcattgatccatgatcatgccactgcactgtagcctgggcaatgatgtgagaccctgtctcaaaaataaataaataaataaaaaataaaatagaggtgagagtttggagtcttaattctggaaggtgaattccagaaaagtaaatttagtggtatgagcaaagatctaaggcaagtctcaactgaataacatgaaaacacatgaaacataaatggatatatggtcactttgatctaaaccacagggaaatgttagaaagttaaagcttgaagagcatagccagatagcagggcttttacaaaggaagagaaatgtaaaacatgaagatgaggaaaagctggacatgtgtcccaatagtctttattgggcagttaagataaactcctgaaaatttaaagggcaaatatggtgctttagttgtttttctgttttgtaacaatatctttatttatctaccttgatgatttcacctgctcttcaatgtgggtcaaggacatggtatcctgcccatttctttgatatcccaaaacaaattcctgctgatggagtttctgccatttatcgtggaagactaaaaacataaaaattctgataattagaaattttaattctcaaaggacacagttgagaaatcctatgaatatgttattgaaagctctcatgtgcaactgtacatttcaaatggcccaccttggttttctgattaatatggaattgtgacgttagatttttggttatcaaaactttactgttagtgttagacctgccttttctttctaactcatgggtgttcaggattcttttttgtcaccaagaagagcttccctggccttttctgagaagcatctagtgagagaagtgtagcggctaagagaaggaagagttggggggcttgagatctgcaggctcctgggagaggcaagtcagctggtggggcaggccctgcagggtgcattgccatagcagtgggtgggcatctctggaaatttccccttcgaggagagaggctgttctttcggaagagcagcttcatctctcttttcttttcatggtggctggtagctcttttatccatttccatcctgttatgcctatggctcttcctcctcaagtaatatgtagctgcagtacagtgagatacagctcagtgcaaactatggaaagtaatggtatttagttagagtctgaaagcccaacttcaagatcttttactgccatttgttagggcatgaccttgggcatggcatttaacctctctgagctttggttttctcatccttaaactgaatattcatatttcatgtattatctgccttatagaattattgaggattaaatgagaaaatgtaagtgaaagtttatcctagggctatgatgatgattgtgattagtattatttaaaagcccagtgggtgggccagtttttgccacctagaaaaatataggactcctattcaaagtcttatggaacaaaaatcatcgctaacttgcttatttgaatttctataatgaagtaaaaatgcaagatagatggaatttttgaagaagctcctgactgttgaataattcttatatattttaaaaactgtcacaatataagtatttttaaagtagtatataatggttcctgaaaatacctgaaatgcccatccttttatacatgtttaagtatgcaatttgttctaaatgtctaatcttgaatgattaaataatttgcatactgttttcagtgctatgaattaaaggctaattgaagtataattttttcacagtaaaattgtatcatcttttatgtagtacatttaaaaatattctaggccagttctaattttatagttttattattttaatttaatgcaccaagtaattaaaaattgctgcaaagaaaagaagctgaaaatgattttaggtaatttcccctcaacagagtgaaaagatgataagtagaataatggaagagagcccaacacagttcctggcacataaagatattcattaaatattccttaatgaataagcaatgactaatttctaagtgtctctagactttgagaaaaggcaccattttcagtgctgtataaaatacaaagaagataggttgacatctttatattaaaatacctccatgcagagttcccacaagccaatttttattgaatcattagatctgcagtttgttctgctttccttttctctttgttcttggagtagattctcaggcctaagtcagttacagatattgagagacaattctccatggtatcatgcatttctgtatctcttgtaagcagaggcactgacttctctttgttctggactatctcttcaaggatgtttatatagcaagtagctgtggaagacaaaaatagtctctccctctggagcaaagtataggtttgcttatagcgttggaagatagaggcttagtgtctccttccagtctaataaagatagtagctcccttggagataaagagcagggatgcttattgctaattatagaagatttgggttccctaagctaagggttactctcctgtaatgtaacccactgcatgtacaaatgttacctggcccttactatgtcatcctgtgggaattggggcttaggaaactggaaaaagaaatgctgatatttaggctattcttactgctgttgattaataaactgccttttgtctctgaccaaggcacctcctgtcttctaccagcatccatgaaactatggaaggctaacttctcatcttgcaagtaggataaaatctcaaacccttttttctttttttcaaattcttttttctttttcttttcttttctttttttttttttttttttttttgagacagggctttgctctgttgcccaagctagagtacagtggtgtgatcatggctcactttagccttgacctcctggactcaagcaattctcccacctttcagcctcccaagtagatgggaccacatgtgggcaccaccatacccagctaatttttttttaattaattttttttttcttttgtagagacaggattttgccatgttgcccaggctggtctcgaactcttgggctcaagcaatctgcctgcctcggcctccaaaagtggtgggattacaggcatgagccaccatgcctggcccctaaacaatccttaacaacagattgcagcaatatttgggtaacttggctggtatggtgtggtatagttggtacactcatgtaggcaaggaactcttttacctccagtggctgaccactcttttggatatacgtgggaccctgggaacatattctcaagaggagaaatgaatgggcatcagggttggaagtagaagatgggatgagatctagagcttttggcccagagcactggctagaactgtgaagcctctgataaccctcacttgaggtagtgcttgggtggaggtggacagaggctatagaggaaggaggaggaaaaataggttgatagaggaaagaagattccatgaaacttcacagcagccaaaagtgattcatccttattgaaacttctaagtcaatgttggcacctatcattccaaagcttactagctttttttttttttttttttttttgagccatgagtacacatttttgtgagcattctgcattggtgccttaatgcctgttgagtgtgctcacattgagtgcttgctggtggctgaatgtgagcaggcttgttctaggaaaagacatgatggcagcgtctggtatttttcgtcattctgcttatgtcccctgtccttcatcccccatcctcaccccagtctttatggtttattaaaatacttcccaagcaccacttaggcaactctaaccacatgcaaggctggccacagagctctgaacctcagaaatctcagctcattctgacttcctcagagttggaatgtactaatgctgcttcctagaacgagtcctttgcccagttttctgttgcgggaaagtattcagggttgttagtgaatgtgctgtatcttcttacttgttagccacatgataaaacagttgtattttctttcatgccatagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggtaaggaattgacgtttgttgagttcttgtcttcaaaataaaaatccctttggaaagtcagtaaagggtgtttgtactcctgatgcagatgtgaaagagcttttagagccatagttattccagttttgttcttctttgggctagagggaaggctgagtgttagccacagagcaagaatgacttcctcactgcctcaccccaattctctctgtagagactctctctttcaggcagtaggagtcttcagtgaactgcacaggtgagacagattctaggcacccacaattgactttgtggtcactgatggtatatgagttgtatccacatttccttggcttgtgtttttgctttttagttgtctaactctggctagaaagatctttgcttctatactagtgatttagtgaagcaagccttgggtacacattttttcttcctcctaggaaattccaggtcctcttaggatggcattggatgccaagatgctctggaagaataaggaagaccatgattctgatataccccctttaggaaaggatgtttatgtacaaggtctgaccccagctagtgtaagggagtaaagactcaatatttttagtattatttttgtcttcctattttttaaacagtccctgggcccaaattttgttttccagaagaatttgaacactcaaaggggggtggaaggtgacaacacccagctaatctccttgctgggactggatcgcaaatgtcttgactcttaccctgatttccatcattgtcacttgtttcctttttccttttctattgaagtgtgattacacacagtaaaatacacagaaattaagtgtacagttggatgagtcttaacaaatacacgtacccctataacctacccccatattgagatgtagagcatttctcttcccccagaaagtcccctcatgtgtttatcgaatcgatcccgctccccaccacagacaactgctgttctcatttctatacccatagatgagttttgtctgatttttattgttttaaaacttatgattcatttccttgcagagaggtaacaaaatttagaacaaaattctcttttgattctgttttgatctctttttaaaagccacttgtaggatcattcatctattcctgcctcccagccccagcagaattattctttaatgttgttgtaggcatacagccctctggagaaatatatatattgttgatcctggaatatctaaggtgaaatgcctgtatattgatgtacaaagggattttttttggtttggattcatttttattttttccaaatgccctggatgaaagagtctagataaatagaaagaatttagaaccagcagagagaacttgaaggaaatggatccaaatgaattgccaccctttgcatatggctgcagtcattcactaacagttgttgttatatgatagtgattgtgaataatgatggattatatgaaaatgcgcagagcactgtgggatttcataggtttatgaagaaaaaaatttatgtatatttaaaattatactttaagttctgggatacatgtgcagaatttgcaggtttgttacataggtatacacctgccatggtggttttctacacccatcaacccatcatctactttaggtatttctcctaatgctgtccctcccctatccccccaccccctgacaggccctggtgtgtgatgttcccctccctgtgtccatgtgttctcattgttcaactcccatttatgagtgagaacatgcagtgttttgttttctgttcctgtgttagtttgctgagaatgctggtttccaacttcatccatgtccctgcaaaggacatgaactcatcctttttaatgactgcatagtatcccatggtgtatatgtgccacattttctttatccagtctatcattgatgagcatttgcgttggttccaagtctttgctattgtgaatagtgctgcaataaacacgtgtgcatgtgtctttatagtaggatgatttataatcctttgggtatatacccagtaatgggattgctgggtcaaatggtatttctggttctagatccttaaggaattgccacactgtcttccacaatggttgaactaatttacactcccaccaacagtgtaaaagcattcctatttctccacatcctctccagcatctgttgtttcctgactttttaatgattgccattcttttttttttttttaaatggagtctcactctgttgaccaggctgtagtgcagtggcgcgatcttggctcactgcaaactctgcctcccaggttcaagaaattctgtgcctcagcctcctgagtagctgggattacagaggcctgccaccacacccggctaatttttttttaaatatttttagtacagacagggtttcaccatcttggccaggttggtattgaactcctgacctcgtgatccacctgcctcggcctcccagtgatcgccattctaactggcgtgagatggtatcttattgtggttttgatttgcatttctctaatgaccagtgatgatgaactttttttcatatgtttcttggctgcataaatgtcttgttttgagaagtgtctgttcatatcctttgtccactttttgattttttttttttttgtaaatttgtttaagttccttgtagattctggatattagccctttgtcagttggatagattgcaaaaattttcttccattctgtaggttgcctgttcactctaatgatagtttcttttgctgtgcagaagcttgttaatttaattagatcccatttgtcaattttggcttttgttgccattgcttttggtattttagtcatgaagtctttgcccatgcctatgtcctgaatggtattgcctaggttttctttagagtttttatgattttaggtcttatgtttaagtctttaatccatcttgaattaatttttgtataaggtgtaaggaaggggtccagtttcagttttctgcatatggctagccagttttcccaacaccatttattaaataaggaatcctttcctcattgcttgtttttgtcaggtttgtcaaagatcagttggttgtagatgtgtggtgttatttttgaggactctgttctgttccattggtctatatctctgttttggtaccagtaccatgctgttttggttactgtaaacttgtagtatagtttgaagtcaggtagtgtgatgcctccagctttattctttttgcttaggattgtcttggctatacgagctcttttttggttctatataaaatgtaaagtagtttttttctaattctgtgaagaaagtcagtggtagcttgatggagatggcattgaatctataaattaccttgggcagtatggccatttttatgatattgattcttctatctatgggcatggaatgtttttccatttgtttgtgtcctcccttatttccttgagcagtggtttgtagttcttgaagagatccttcacatcccttataagttgtattcctaggtattttattctctttgtagcaattgtgaatgggagttcactcatgatttggctgtctgtctattattggtgtacaggaatgcttgtgatttttgcacatcgattttgtaccctgagactttgctgaagttgcttatcagcttaaggagattttgggctgagatgatggggttttctaaatatacaatcatgtcatctgcaaacagagacaatttgacttcctctcttcctatttggataccctttatttctttctcttgccctggccagaacttccaatactatgttgaataggagtggtgagagagggcatccttgtcttgtgccagttttcaaagggaatgcttccagcttttgcccattcagtatgatattggctgtgggtttgtcataaatagctcttattattttgagatacgttccatcaatacctagtttatggagagtttttagcatgaaggggtgttgaattttattgaaggccttttctgcatctattgagataatcatgtggtttttgtcattggttctgtttatatgatgggttacatttattgatttgcatatgttgaaccagccttgcatcccagggaggaagctgacttgatcttggtggataagctttttcatgtgctgctggatttggtttgccagtattttattgaggattttcgcatcaatcttcatcagggatattggcctgaaatttcctttttgtgttgttgttgttgttgtgtctctgccaggttttggtatcaggatgatgctggcctcataaaatgagttagggaggagtgcctctttttctattgtttggaatagtttcagaaggaatggtaccagctcctctttgtacctctggtagaatttggctgtgaatccatctggtcctgggctgtttttggttggtaggctattaattactgcctcaatttcagaacttgttattggttggtctattcagggatttgacttcttcctgggttagtcttgggagggtgtatgtgtccaggaatttatctatttcttctagattttctgcatagaggtgtttataatattctctgatggtagtttgtatttctgtgggatcagtggtgatatcctgtttatcgttttttattgtgtccatttgattcttctcactttttttctttattagtctggctagcagtctatctattttgttgatcttttcaaaaaaccacctcctggattctttgattttttgaagggttttttgtgtctctatctccttcagttccactctgatcttagttattttttgccttctgctagcttttgaatttatttgctcttgcttctctagttcttttaattgtgatgttagtgtgttgattttagatctttctcactttctcctgtgggcatttagtgcttataagcactaaatatataaatttgcctctaaacactgctttagttgtgtcccagagattctggtatgttgtgtctttgttgtcatttgtttcaaagaacttatttatttctgccttaattttgttatttacccagtagtcattcaggagcaggttgttcagtttgcatgcaattgtgcggttttgagtgagtttcttaatcctgagttctaagttgattgctctgtggtctgagagactgtttgttatgatttccgttcttttgcatttgctgaggagtgttttacttcccattatgtggtcaactttagaataaatgtgatgtggtgctgagaagaatgtatactctgttgatttggggtggagagttctgtagatgtctattaggtccacttggtccagagctgagttcaagtcctgaatatccttgttaattttctgtctcgttgatctgtctaatattgacagtggggtgttaaagtctttcattattattgtgtgggagtctaaatctctctgtaggtctctaaggacttgctttatgaatctgggtgctcctgtattgggtgcatatatatttagtatagttggctcttcttgttgcattgatctctttaccattatgaaatgcccttctttgtcttttttgatctttgttggtttaaagtctgttttatcagagactaggatagaaacccctgcttttttttgctttccatttttttggtaaatattcctccctccctttattttgagcttatgtgtgtctttgcatgtgagatgggtctcctgaatacagcacactgatgtgtcttgaccctttatccaatttgccagtctgtgtcttttaattgggacatttagcctgtttacatttaaggttaatattgttatgtgtgaatttgatcctgtcattatgatgctagctgattattttgcccattaattgatgcagtttcttcatagcatcaatggtctttataatttggtatgtttttgcagcagctggtactgatttttcctttccacatttagtgcttccttcaggagctcttgtaaggcaggcctggtgatgacaaaatctttcagcatttgcttatctgtaaaggattttatttcccccttgcttgtgaagcttagtttggctggatatgaaattctgggttgaaaattcttttctttaaggatgttgaatattggcccccactctcttgtggcttgtagggtttctgcagagaggtctcctgttagtctgatgggcttccctttgtgggtaacccgacctttctctctggctgcccttgacactttttccttcatttcaaccttggtgaatctgacaattatgtgtcttggggttgctcttcttgagaagtatctttgtggtttcctctgtatttcctaaatttgaatgttggcctgtcttgctaggttggggaagttctcctggataatatgctgaagtgtgttttccaacttggttccattctccctatcactttcaggtacaccaatcaaacgtacgtttggtcttttcacatagtcccgtatttcttggaggctttgtttgttccttttcattctttcttctctaatcttgtcttcacgctttatttcattaagttgatcttccatctctgatatcctttcttctgcttaatcgattcagctattgatacttgtgtatgcttcacaaagctctcgtgctgtgtttttcagctccatcaggtcatttatgttcttctctaaactggttattctagttagcaattcctctaaccttttttcaaggttcttagcttccttgcattgggttaaaacatgctcctttagctcagaggagttagttattacccaccttctgaagcctacttctgtcaattcatcaaactcattctccgtccagttttgttctcttgctggcgaggagttgtgatccttcggaggagaagaggtgttctggttttttggaattttcagcctttttgtgctggtttttcttcatctttgtggatttatctacctttggtctttgatgttgttgaccttcggatggagttttcatttggacatcctttttgttgatgttgatgctattcctttctgtttgttagttttccttctaatagtcaggcttctctgctgcaggtctgctggagtttcctggaagtccaatccagaccttgtttgccttggtatcaccagtggaggctgcagaacagcaaagattgctacctgttccttcctctggaagcttcgtcccagaggggcaccctccagatgccagtcggaggtctcctttaagaggtgtcaacccctgctgggaggtgtctcctagcaggaggcacaggggtcagggacacacttgaggaggcaatctgtcctttagcagagctcgagcactgtgctgggaggtctgctgctctctttagagctggcaggaggaacgtttaagtctgctgaagctgtgcccacagccaccccttcccccatgttctgtgtcccaggaagatgggagttttatctataagcctgtgactggggctgctgcctttctttcatagatgccttacccagagaggaggaatctagagaggtagtctggctacaaaatcattgctgagctgtggtggactccgcccagttacaacttcctggcagctttgtttacactgtgaggggaaaaccgcctacacaagcctcagtaatgggggacgcccctccccccaccaagctccagcgtcccagatcgacttcagactgctgtgctggcagcgagaatttcaagccatcggtcttagcttgctggggggatccactgagctagaccacttggctccctggcttccacctcctttccaggggagtgagcagttctgtctcactggtgttccaggcgccactggggtatgaaaaaaaaaaaaaactgcagctagcttggtgtctgcccaaacagctgcccagttttgtgcttgaaacctagggccctggtggtgtaggcacttgagggaatctcctggtctgagggttgcaaagaccatgggaaaagcatagtatctgggccagagtacactgttcctcacagcacggtccctcacggcttcccttggctaggggagggagttccctgaccccttgtgcttcccgggtgaggcgatgccccaccctgcttcagctcgccctccgtgggctgcacctactgtctaagcagtcccaatgagatgagccggatacctcagttggaaatgcagaaatcaccctccttttgcattgatctcgctgggagctgcagaccagagctgttcctattcggccatcttgccagccacccccagaaaaagatcttttgtgccaggaattgagaataaataccaagaacagctaagaaatgttttaaataatttcctttcagagtaggaacatcattttagcatttattccctcagggagaaaattcttcaataaatatagtaatctttgggaaattaggagtttaataagaggcttctatattgactttcatacatttacttctgcagtgtttgctgtcttgaactgtaaagttaaaattaaacaatttaacttagactgaaaagaatcccatatattatcaataatgcttttcttagaggcctcataatgccaaagaaacatttttcaatcaattgaaatagtggtcccataatttcatttaaatatcagagataagactgaagagtctttggaaagccatcatgtctccccactgtcttgggttaagactgcacctagactgccctcgacagatagaaatttcaaaaatttacaaaaagattgtataacctgatttgggataacatctcccttgtcagtgtgcacttccttatataacagtcctatttggttacatcagatgaaatgggggcagtttaactccacgacagggctgcgaaagtgcaaatagagggaagagttgcatcaagaagactatggaactaactagtggttcctgggacagaggacagccgaggcagaggctctgcagaccttaagaccttctccatttgctgtgctcctgtttctccggggcattcttatccttgatacctaaagctttttgagctgaaataaaacagtgaatatatttcttcccttttaccttcacaaaaatctttgaatgagtaagaattatgaacacatatgaatttcccagtgaaaagacaaattatgtatttggttgagatataattaatacggagtcaaacatataaatcttaagtatataggtcaacaagttttgtaaaatgtgtgcaattgagtaaccaacacaaaaatcgagatgtagaatatttttaccacctcagaaagttcctttctccccatttctggtcaaattccctacccagaggcaattactgttctgatttctgtcaccgtagattagttttgtctgttcttaaataagaattttaaatctttttgaaaagtcagttttaaaaaatattaaagaagtatagttttttctttttttaatctttttttttttttttttttttttttttttttttttttttttttttttttacagagtattgctctgtcacccaggctggagtgcagtgacacaatctcggctcactgcaacctctgcctcccaggttcaagggatcctcctgcctcagcctcctgagtagctgggattactggcacctgccaccggacctggctaaacttttttgcatttttagtagagacagccaggctggtctcaaactcctggcctcaagtgatcgacccactgtggcctcccaaggtgctgagattacaggtgtgagccaccccgcctggccagaagtatagtttagtgtattaatgtttaatatgaaaaacttcctcaaacttgtttgtctctattctttttttttttttttttttttttttttgagatggagtctcactctgtcgcccgggctggagtgcagtggcgcgatctctgctcactgcaagctccacctactgggttcacaccattctcctgcctcagcctcccgagtagctgggactacaggtgcctgccaccacgcccggctaatttttttgtatttttagtagagacggggtttcaccgtgttagtcaggatggtctcgatctcctgacctcgtgatccacctgcctcagcctcccaaagtgctgggattacaggcgtgagccaccgcgcccggccagttcttaaggttaaaactggttatagatgtgtatgtatctatgtcatagttgaaattaaaaacaaaatcacagaataatctgtagaaaaatatatcttttttgttttcttttctttttttttttttttttcgaaatggagtctcactctgttgaccaggctgtagcgcagtggtgtgaacatggctcactgcagccttgacctcctggggtcaagcaattctcccatctcagcctcccaagtagctgggactacaggcgtgtgacaccacatctgcctaatttttttttttttttaagagttgtgtttttgccatgttgcccaggctggtcttgaactcctgaactcaagcagtcttcccgccttggcctcccaaaatgctgggattacaggcatcagccaccatgcctgaccaaaaatatatctttatatatttgtcacttgattgtgtatatcttagaagtgattatgcaaaccctgcaactattattgacattttctccatttgcaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaaggtgagcagtggatataaccactttgaatttgcttgtgggtcaagagactagtcactgtttggaatgttgtgtgttatgactatatgatgatagtaaccatgcactagtgcaggtatttagaaacctttcattttgtgccctctattaatacacatctgtgaaagtaatacagagaatatgatcaattagagttggaacattgaagttaaggcaagtaaaggaaaaaagtcaaatgtaagaaaaagcacctattcatcattgagttcacatccagttttatgaaactaaatgactccttagtaaaagaattgcttgtggctttggacagggcactgcagactactgaagagagcccatggtttggtctgggttgtgaatacaaacacacacttatacacgtgcacctacatgtgcatgtacacatgcactcacaaacatacacatgcaagtttacaaaccaaagtgccttttctgaatgtagcaactagtcaccaactagccactagctagtggcagtgatgacttttgcattttatttaacattaaaaagagttgtcagattgatttctacaaatatttatggccatttgagagctcatgtaatttgggtgcagcagaaacagcccagacctggattagagttgtgagtctgccccttaatagctgtgttaccttgggcaaatcacttaacctctttgagcttatttccccatctttaaaatgtcataacatagtaaaaaaaaaaaaccaaaaaaacaccatctaaggacctgtaaacacctataaggacacttaagaacataaaggctttttcaaaagctctatgttatattttctttcttatttggataaagtgtcttcttagtgcacatgaaaaggttaccataatgctaatttccgaggcaaataactgctggccattcagtcctcaccgggaggctttcccagattctctgagcccactgctggaagccctactgcgtttgcttggaggcaggagaggcacaatttgtcccagagggagccctgggatacccatagcaggcaaccaggaggtgtcagaaaaacctgtttttagaatgactttgaaaaataggctgaatataaaataataatgacatacctgacatttacagtgtgccaacattagttaattcattttattcattcattcaacaaatattcattgagtgccacctctatgccagccctggggttatagtaagaaagggaatggattaaatcctaccacatcttgttttgattttgtcttccagaattgcccacctagagtctatcaaccaggccagataacagatcgagcagttctcaattcatatggtgactttataaagaaccaagcggatggctacctgttcgatagatataagggaaggaacctcatattttattacctgtttctagtgtgacttctttggaacctgaacagtggggcgagttacgtactcttctcttgtgagattgtgaatgaaatcgatgaatacataaatgtatgcattgtactgctatttatcagtaataaacatgctgaaatgtctatataaatatatgcaatgcattgcagtttgtaagtataatactacagtgctaaaataatactttagaatattaacatcaactggttgcttttttatttgatttttaaaatttagttattaaagattgaagttttatttttaatttcctttttttctctgggaaggggttcctggttctttggagggtccatggtgccaatgctatgttcctttgtcttttttagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattggtaagtgatacatatgtcaattaaaaatatttttaaaattaaattgtttgttccctaattaagattttactttggagtttcaaatgctaggctcataatagctaccacttattgtgcatttgctatcttccagccgtttgttgtcttatatattcctaacaattctctatggataggctcattatccccattttagaggtgaaaaaaaccgaggcttaaagggggctcatttgtccaaggttatacagtgagcaaagagtgagccaagatttgaacttgtctgcctgatgctgggggggtaaatgttttggtttagcaatcgaaatggaaatctgaatgcttttcttttcacttacttcttcttaccacaatggatatacctaattgagttattgagggaattctcttctgctagtttgctctacctttcctggtgaggctcagccaggttttaagcttctctcttctcagatattaactccattccagtaaggttagttcagttcagaatgaaaatgagtgattgattaagcacctactatatgtaggtcactgtagtagacttaggagatagagttgtgtaagaggtttctaggctggaaggggaactgagacctgcagcgagtgacaccgtgttatgagtgtcttggaagctggcggaggatgtgacgtgaaacctaaagcataaaccctcatttgttaaactcccctctacctgaggctccaggtacctgctgctgctaggaattgatgggacttgctgacctcccagtttggtactggagttgggatagtgggtacttagtcctgtacttctttctgaaccttggagtattcatatgaacacacttccccgaggggcaagatggaagccaagtgcaaccgcagcttcttgaaagacaaggtgctttgtcactagaatgagatgaagccatgttatgtgtcttgttgtccgcattgtgtagtattcctggccttctgggaatctttatattgtgagagaaggcacatcaagtacacaagggggttagagtgaaaaaggcttacagttttactcttaggttcattaggggaatttgttgcactgcatctgcatgccagattagtcaaaatgtatgggccctactggggccaaattggtggcctctttttattttctaaaattagtccccttcagtggacacagttgggcatatttgccttggggactgtggacaagaagcagccaggaatgtgcaggtggcagctgctatagagaagctgctggtggcccctagactgtgggaaaagaatttggcctttaataaatgtagatgcctgtttggaatccgtctttagtgtagaatgaaaatttaaatgtatatatcaagatgagtcaccaaaaaccgtaacttacacctgatgattaccttaatataaaggatgtggtgttccaaagcattatatgattccttaaacataaagtctaacttttggttgatgtttgtctgtcagcttggtgagaatatgaaagttgcatttgggaaaatgaatgtcctactggtgggacttagtatgttgttagggtcttaacggcttctctagaaaattttttgaggcagtgtgaattccctggtgtgctccaaatcgagccatcctgggtaaatgtatcagcttcaaatgtcctatggtccatttcagtcgagtccttgtgctaatttctttctgttcacttcttttgttcactccgtggactaattgtattatgtaaaaaaaaagtagtctgtgcctctaaagctaatataacatgagcattatgcatttaaacagaaaattatgcaaatgcaaaattatgatgcatttcatagtcacactgactttttatatttctcataacatatgttaaaatatcccatttaacagacactattattacacaacatttcttgtgttacaacagtgtacttaatgtaagtaaagactagaaattatatctatgatgaggtggaggggagaatgaatcagtgttctctgataatctttgcatttgcttttcctgattttttggtaaggttaaattaatatccttaatgttgcttagatacagttatttctgccattttaattttatttatagttcatctggtctcagcaattttttaaattgaccaaattacatgcgttatgttttggtatccttaaaacccaaaccaggacaaagtcccatcaatcattgtggttctgtcaataattgtggtcacatttcctcctttgtcaataattgtgttcagtagaaaacctgggtatctccactgtgcagcacgcaggaaggatctgacaagcagcagcaacacagctaggggcgtctctagcaggaagtcacgggagatttctaacgcagtacgccgccttggtgctttagtaccttctcctgtgtaatgacaccccaacatattttgggggagaaaaaatggcagacaaagagaaggagttggccacagtcccaagaaaggtacatggataacctttctatttatgtagaagtggagggcttgctaaaattccaagagacatttgagctcctgtgtaaaactcaatctcttaagatgattccttcatacatttaaggattctaaggagaaggtgattccatagatttcttctctttaatagtgcagtgggaccccctccatcagacagtttggccatcctgctggccctggcttgcctgccaggctgtagcatgtcactccctcattattttatgtgaatgaacacggtccggcagatggaggtctgttgatctttcctatagcatgaaggttgaaaaaggctctaggggttccagcaggtgtttctttcactaaaaggacagggatcaaatgtaaactgttcttacgtaggaatttctgctttaggttattatttgtctatcagtggactttcttattttttcttagtggctgggacaatgaaactagtaacaagattgttcattcttgttgctgttgaacacttattgggctatgcttagattcaacaaaaatcttaaagcacctttaattttgtggagtcatttctggccatctctgaatttttaggaacagcaggacatttaagatgagtgtttaatgattatttgagtgaattggacacttaaaattgcaccaataggatagaattggcttctggtctcatcacatggccctgatggacctaacaattttgtttcttttgcttcccctatgaaatgaagatggttgagatgggaggattcttaaagattttatagctctaacataatgtgattcacgaatttaggtttcattgaaatcatttgacatgggtattgaatacaagcacaagtggatttaccttgaagctaatgaagcgtaatctttagaggtcttcctttccaggggtcccaatccaaggccctggcctaactttgtcttagtaatttgacattctttgcctagaagagctttgcccaaattatttaagcttccagcctcccaaaacctgtattcatctctaggctactagaacataagcagtgaacgttgaggtaactgaaggcttttcccagtagtctttcccactgagatggtgaatagaaaatcaccacgaagaagcattaagactcctttgtaatatgtatcatctgtctgccaatttgttggaatctagtcaaccatggatgggcattcaatatatatatgttttgacaagtcacttggaattagaggaatcagataattaaaagacatatctgtctcaggatctagcagaatgccaacttgagacattggggaagatgctttgtacaaaaatgtatactttttcatttattcaatgaatatttttgaacacctaaaacacgcaggatgctgggatgatggaaaaccaaagtgaggaaacttgtcattcagctgtgagtccagagctttgtgaacgtatgcaaattacccagataaatgggatttaaagttggatcttgagccagagtttccaaaaagatgtatgtggtggtataaaagtcaggcatgatggagtggaaaagttctcagcttttatacactagatggcactgtgggtgcagaggaaagctctaaattggttcttttgttacttaaatctgttgcaaaaattatatggttgagaaaacaacagtgtggtataagccctgtaattctagggggaagtgtagaatgcagtcctaattactttgagattcaatatgtgtcctcttttggttagactgcttagattggtatgtagagttgtatgtatatgtctcctgttgaaagaaactcctcaggcccagatttttaaataatcacatacagctctcctgccatggctatgatgttcttcctgaaatgaaagaccaaacagtggtgtgttagatgtaatggttagcaatgatagagtctactgcaattctgcccaattccaagatttgaactctcctctttatttccaagacttttctttaaaatcaccataaaaatagcaatagttgaagctcacaagtcacttctgtactggcacactggctcccccctttcactgagtcacctttataaacatgtctgctgtaagcagtctctgttaggatgtaacaatactcttttggggattgtttttggggaaatttcacacaaaggctgctaggaagtctaaggacatatgaaagctgaaaatgttttcaacaagagttagaagtggcctcaagcccttagccttttgatcatcagttaaaaaacaaaacaaaacaaaacaaaacaaaaaccaaacaaccaccttaatattaagagttaggttatcttggatgaaaaattgatctccattttctcttccggaggtgtgcactaaaatttgtactcttcctctatgggaactttgacagtggaaaaggaaatatttgcttatgtagaactcctttcatacaggattgaaaacacctatgtcatactgaagcttggggaagaagtagaaaatagattctgtgggagtttgttttgttttgttttaggaaagatgtggcatctttttttgccatttatgttggggacaaacacagtgacttggatagaccaggtcaatatgttccttgctctggagagcacggttgcttctgagattgtacagcctcgcaaatgagtacctgaaagctcctaggctattacaaatatgttaccagctctctctccacctctctttcctcacagatgataagtatataaataaaatcaacagtatttaccgcgtagcactcccttggagagagtaggcagttggctattttaaaagttttttctttttctgttttgtttgttcgcttcattgcatttgagtgcaattgtagtcttttcttgggcttaacaaaagctacctggggccgtggctggtgagaggaaagttctgttttggtgtttgtttttgaactacatagggaagtactatgacctggagttactttggaggcaatggagggtactcaaatacagggtgcagtaggaggagatggtggatggggaaggataaaggtgaatagtcaggagtaagtcctgtttggaaaagaattttattagtgagtgttgactgagataggagagggctaaattacaggttaaaatgtggaacgagtggcctaaagtttcaagtttgaattttcatattattggaaaaatcagaggagaacaaaaaatattcagaaatgggaatgtgatgacaaaatataaacgtttacttatttgacatagattcttttttttttttttaacttttgaaccaatggtgattattaagtgagttccatggtttttgtaaacatgattgaaaagtactctcacaggattttgctgttttgtttgaaagagtttaaaatagtctacaaagatctccatgttcatcttgaaaacataacaaacctttcaaaacagccataatcagggcaaaaaaaatattgatgttttgtttgcctttgttttgttctagagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacaggtgcttgagggaaccatgattttagtctgatctttcccaaatgtgtttggggtttataacatagttctcatgacgaaacagatgtcacgcagctcatctaattgcaagtccagggagacattattataggcttttaatgaggttgattaacatgcacgtattaacaggttcttacctgagtgcttattttaataagtatcatctggaggcccctaaagtaatattatctctagtctatgttgcctttccatatctatctatatatctgtctcccgaaaataggaaagatgtagagtaggagttaacaagctctttcttaaagggtcagataggaaatatttttggccttgtgggccatacggtgtctgtcacaaccactcagatctgcctttgtagcgtgaaagcaccacagacagaatgtaaatgattgtgtgactgtgttccaataagactttttttatggacactgacattcaagtttcatgtaatttttacatatcacaaaatattactcttattttgatcttgccaaccgtttcaaaatgtaaaaaccattcttatctcaaaagtcatataaaaacaggtggcctggtagatttggctcactgactgtggtttgccaacccctgctatagagatttcaaggatttatacgtgtttttaaaagtgttatttggtgattaatgttgttttcacttgagaggttggttgagttcagtaaccataggtttctcacttggctgaatataattttaaatgatggactttcagaagtattcctaatagacatggagaaaaacctgcctgtaaatcatgcatatagaatgtagacactgccctcggctactttttgcttctgcagggagagcaggccctggagaaagaagtcaggggaaaagtggtggggaaacattgtaggtgcttgaataggatgtgggctaagggttacagtcctgtgtgagggaaataatggataaggagattctggggagaagcagtgataaagggaatgtggtaagtctaggagaaggagaagaaaaagacatcctgaatttcataaaattgattggggtcaggtgctgttgtagcacatttgaaggagagagaacagtagttatgttgtatctataaaagtggtaaaaattgattaagaattatatagaatgtcttaaagtctgcctttgctatgacatgatgtcctttgtctttctagaaataatcttttacttttaaggattttagggttctatttttaagttttagatttgatgcttctcaggagtggtccctgtactttttagaaatgctaattattgtgtctcccccacccccagactgactgagatagaagctctggggaaggggcccaacattctgaattttctcaagtcttccagtggattctgagacacaccagtgtttgagaaccactgatttttatcacataagagggttgccagcttatactctgtcctcccttatcgagaacagtgtttaggtgaggttccagggtaggacttttgatggctaactgctgtttttaaggacagccacccgaaggaggcgggcaggaagaatgtccctattgtaaaaggagagggaatttttcttataagtaaacaagatgaaatattatccagggtgttgtttctggaacccaggggaaaaccgttctttgtgagtagttgacttagtccctctttctgtctacactgggtaaacttgcccacagaacactgactgtagatggtattccatgttcttttcatgttgtcctggctggagaatggtagtataggcacaaatgtctctcattttgttctttctgtccactgctcaatctgtgccaggaatacactttcctcaagctcttctcacacagggaccatgtttccatagtaactagcacattcggctggagacttatagatgagtttgaataacccaaggttttaaaactgtaagaacctaaggaagatgatttcacaaagcatacaaagaatagttttttaaaatacaaataaactgtgaattgagacatggaattgtacatgacacattgattatatatatattgctattaaaaatgtacttggtgctattattatgaggttaatgctgatctatgagtcattggagggaatagtttcagattaaagcatatgagcttttgatggatataaagatcttctttattatctgggtagatatcactgcggtagcctgctgggcagattgtctagtctgaggagggagaaccaggataatatctttcttgctgcaccaggctgaattagttactctgttctttgtgtgcccacagtactctgttgattatatttctaataataatattactactattactgattactcataataagccattagtggttactatgtgctatgttacaatacttaatctaatttaatcatcaaatccttggaaagtagataatgttattgtacccattttttacatgagaaaactgaggctcagagaggccatacaacttcctcaaggtgacacagctaatttttagctgaactaggaactgaacccagggaaatctgacttctggaatttacctgtctttcgacagaacctatacatataacagtgcatcttaatgacttgtttatgtaatttgtgggctccttttagaccaagagctccttgagggcaggggccagctttattgcttccataagagttagtgctggctatatatttggggatcaatagtttgtctaagaagagaaggaatggatgaagaagtgagcaaatagaataaatgttcactcatccagttcttaatcatggatagaagagacagatgacttctcaccaggagggttattataccagacttgtgccagtcataaccatatagcatccaaaaattcatggtttaatcttcatctctgtcttgttacagatattgtccatctgctgtccccaccagtcattttttttcttcttttaaaaatgtttccccattaataaaaataagccttcatgtgtgttccaaccataagactctatagctctagatatatttgaggtttttagtaggtgtatagccctggatgagccattcattatcttagtgaataactagttcttgaatccctgctgtgtgccaagcagtgttctgggtgtttgtgatacatcagtgaacaaaatagacaccaaggcctgccatcgtggaacttatattctagttctgggaggtggaccatcaattaatacataagtaaattatgaagtatttacaagatgttaagtactgtgaaaaaaataaagaaggtattaagttgctgtggaaagaataaaggcagattgggagtatggggctgaggaacattcctggttgcaattttaaatagtgtggtcttgatggactttactgaggagaggaaatgtgctccaggcaaaaggaacagtcggtgtaaaggccctgagcaagaagtgtgcttgggatgtgcaaggagcatccgggaggccgacatggatggagtagatgagtaaagagcagagcacacagagaggagatgagagtgtatgggggactgggtacacagggctctacagactgtttaaggatgcttttgactttgagtgataagggggccattagaaaatttgagcagagaagtgacttgagctgattttcttcttaaaagaatcattccagtgtagtgttgagggcagactatagatggcagtggtggaaattaagactgggtaagaagctactgcagtagtccaagagaaaagttttggtggctcagatctgggtgagcgcagtggaagtgatgaaattaattagtggatcctggaattattttgagggtagggccagtgggattccctgacaaactggatatgaagtatgaaagaagtgaggagttaagatgactctcaagatttgggcttgagcaactggaagggtggagttgccatctactgagatgagaaagactggagatagggtaggtttagggacaagagtagaagttcagttttagaaccagttaagtttgggatgtctattagatatcaagtggcaataccaagtaggcagttggatacatgtgtgagtatagggttcagaagataggtgaatgtggatgccatcagcatgtagatggtatttaaagccatgataccaaattgtattaaagccttgagattggatgaaatcaccaagggagtgaatatacctagagcagagcatgaccaaggaataaactctggaacatccccaattaggagcttggggaaaaaaggaggaaccaacaaaggagactaaaaaggagcaaacaaggaggtaggagcacaaccaagagaatgctggatcccggaagccagtgaagcaagagtaacactgaaggagtgatcatttgtgccaattgctgctgattggttaagttagataggcacaaaaaattaagcattggaattggcaccgtggagatcattgttgacctctacaagagcagtttaggtagagcaaacctaatggaaatggattcaagagaaaatgggagaagaatttgaggtaatgattttagataactctgggctgtatgtagaaaaagttaagacatggcttcttgacctaggaacttataatttgtttggggacaacgggaataaacacatttttaaaacaaccatccaagagtaaaagtctatatagagctaaattgggtgtggccttacaattgatgcaggaggtataagtaggtggtcagctggagcattgtgataaaaaagaatattctgggaagtttgaaaagtagttattagggaaatatctgaaaacatttgcagtgcttctcaaagtatgcccaggggaccaccttatcagaatcttctggggtgcttattaataatgcaggtttctggagatgtgagctaactactgaatccccccatatctctggggattggactctggattctatatatttaacaagctccccaggtgacttttatatataataaactttgtgaactgctattctaaaagttttattgagtagattatattctcaattgatgagatctccagaacactagatttaggtgaaaaaaaaaaggcatattgaacgtgtgaaaaacccacacttaacatgtacacttataaattataagaagttaaatttacagtaatattccttttcctgaagttagaccttcctcagttgtttcagtgatatttctagtatctgaaatgttatggctttcttgtgtgagaggggctaccaaatctatttgttacatataaatccaattatataccagagaagatggttgacaaggcatagcttccccccacactatatgaggtctgtctgaagcctggaaactgggtacagagaaaacagccatgcagacctggctgctttgctcaggctgttctggggtgagccttccaaactgctgcacaccgtctcacatggggcctcaagcctaggaatcttggtgctatcctttttcagcccggattcttgtacagcctgagaaaggagcagagaaaagcactttttgcctctgcaaatcagaaatacttggtttattttttaaatcactgtgaacacaaggaaagaatgattttcagtataggagaccctgcaagggaagacttctctgcttagagttgtgacagaggacatggtttattctcctgtgtacctccctggggtaatgattttagttatcaaagacctctccaagggtttactgtttcttacaaagtccacctttcactagcggatatccacagacatgcttctgctacagaccataaatcaatttcttcagtgaccaggcaatcagctttggtaacttttaattctataatttgatcctatctttagtctactagactattctatttatgcatagaattctgagtgcaaattccaatcaatacagatctcataacaattttccataaacatttattgaatacttacaatgtaaaaagtattatattagataatggttaataagacaatctttgtccttggaaaacagacttgtaatggcttacaatacgagtgataagcactatttaaaaaaaaaaaaaggtgggtctatcatatttgttatagcatttgaaaaggaaaagttaatttttcccttgaaggaagttggggggttgctggggagctggaggagtgagtctgagaggggaggatgtgggctggaagacagaaaagtaaagggcatgagacagtgagtggtgaatgggggaggtagccccagatactggcagagcccaggattgcccaggcagtagggctaggtgcttgctcttctttccagcatgattattgtgattggtgactagccttgtcattagagaacagcctgttagtgcagctggtttgaacagtgtgtttatgacgtttgttttgggttcattttcccaatgtgttacccaggacatgtaaagaatcagagatatcttaatatactgagaaaattcctctgcatttagatttagaaccttaattagacgatggttgaactctttcactttggacagtttatgcctactatattaaagccatattatatcttttgcagacttttaaaaacataatatgtggaagattacctgtataatgctctaactctcatttctcttccatttagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggtaagagatatactcttcacagtattttcttgagaacattttaagtgtctcttcatgttgaaaattagggaacatgatctgattttgtagcttagattatctacaatagaggctttataaaaaaaaaccctgaacaatagggttctttttacagatctcttaaatgggaacctaaacatttaaaatgatagaagtggaacagttttggttggcttagggctgggagacctggggttacctccttcttgccactatccccacttccgctgtggcctctgaggtacctctgtggaacccaagggcttcaaaatcatggtctgagtaccactagttttacttgtatccagcaagccaagaggaagtctgtattcttggtagtcctacttacaacatttttgtttggctgtaagacaagaatcccagatacacaaattcaatcgtcagggtccatctttatctggtccttctgtctgttgaggttgttgccaaggttccagcactcaggcccacagaatgcctctctgtaatatgctggtaccactgtcattgctgaggagaggcattgacttgcccaatcatggcactgtaggatcctgttctttgtctcaacatgtttagaacttttatcagtgctgaagacacgcatttgggaagaataatcagtgatgtgctggttaactggctctttgaaaatattttaaaagccctgatttgtactgtttgccagtttccatggtgtgaataccccaaccatggccaatttcaagcagccaagagtttaaaaactggcttgcaaaatctctgaaaattcaactgtcagctcctatgagctggtatgagctacttagcacaccaatgagtaaggaataacttgtataactaaggctccagagtgatttgaataatggatcaaatcttaaaatatgaaattgcctagggatgaatataagtcatgctcttacaggtcaaaaatcaactctatacacttagaatggggaagatgtggccaaacaagttgcagcatgtatgaaatagaaaggagtgatggtagtcaacaacaagcttactagtaatcctagtggccatgattgagaacttactattatccttacaaggactttatgaggttaggttttgtgttagtccagctcctctaagaagcaaatgccaagacaggattaaatatgcaagagatttaatagggggaatgctggtgagggaaaatgtggaaggagccagaagaggctgggagagctg[450 bp omitted]ttgaatgtggtaggaggagtgggatgaagtgaccaaaaagcttatctggtctcaggctatatttataggtctgtagatttcagttcagtatcagaagatcctggagttccctgttcaactctactggctactttccaagaggtcaaaacaaataatgtctagaagagaacagatgaaatgatgacagttctggaaagtaagaaatatgaggcattactaaaagaagcaaaggaattttacctgtaggaaaaaaagacttaaggggactcccatagttatctttaaacacttaagtaatctcctttacagaagtagggcatttgctacctaatctgcacgtcagattaagtataagacatcatctgggacaaataggtggaaataagcacaagtgaggaattttctaactggtactgttcaaacgtgctctaaagatgagtgccttcctgatgttccacactcccagtatgctgctgggcatatataggaggtccttgccaagtgtttattggactgggaagggagtagacagagagaagaaaaggctagaattacacaccattttttctctgttttttcttttttttgtttttttgagatggaatcttgctatgctgctcaggctggtcttgtactgctggcctcaagtgatcctcgtgcctcagcctcttgcgttgctgggactgcaggcacatgccaccatgcctggctttgctttttgtcttgaacatcctcacctaggaagtcttatttcttcactcactgcctcattcttcccttaagtccaaaaataacaggcaatatgagttcacaggtaacttatatggtggtctgtgcttgaagataaagtaactctgaaggcaagtcacgtggttcttttaagaataaaggctgctcatgaacttttctattttttataggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataaggtgaatttactttgtataattcttgacttgcctctcagccctccgcagtctgtgtttttctttctctagggccttttcttcttcatcttgccaccagttgtacattgtgcattcacacatgtgggcatgaataatggattcgtgtgacttggccacatgtcccatcacagaggccaggttcttgtctactctgtttacatgctgggttctcttctgcccagcatcacggattccaggcacaggcaggaggcagggccagggttgaatcaagtttcctgggttttctgctgacgctaacaatgttttcagaaagaaattcaacaactataggaaaggaagaaaaatctggtgccacacactgtgccgtcccagttaattggcacaggccaacagagaaggccaagacctgaacaaacagaaacctcaagggaactgaatagttgctgggtttacaacttcccataacagtagccacctgaggcctaaataaggatttaaggataaactggcaacagtgagctcaaagagtttttttttttgaaataagatggcagatgggtactgttactgcaagtgccattatggcaatgctgttcggtaaaaataacatattgataaaatcttgattttaaatgtggactagttcggtgtacaaacatgtttatttgggagtcattgcctaatatggaaaaatctatctggaaaattttattttaaaagtttacctataagtgataatatttatgtgccatttatatacatacagtgccaattttgtctcatttatatataaaatggctggggttaagttgctaagattgatgtctctgtgtacatcacatcattcatatcagtttggatcctctgagaagcagacgccaagacagaatgagaagtgtgagagatgttgtggtggaaatttctgagaaggataaagggggagggggcaggagtgggcaggggggaccttcagaccgggaggcaggttgaacccctatggaaggagagcgaaaggaaggaggaggggtgggtagggagagcctcagctgacaacacagctctgagaaagtctcaaccaggctgatggggagccccagagcacagactgcccatcagagaggtcccctgtcaggcaggaatcacctggttctagtccccctgctgtgctgtgtcattgggtgggaacagcttggggagagtgtggccccagcagcgacattgcctgtgaactctgtgtgaatccggaaggtatggcagctggagtctgtcagccaacaatgctcttctccacagggtctctcttgataggaggcctgagaagcgccctccatggctgccatgccatctctccatttgtagtcttagggattcaggttatcataaaaccttgaaccagtagctattcgaaaacactgaatctagatgagaaactcagtaattgggagtttagatttctggagaccagcaggcctggcttgggaacctgactccacattaatagctgagggaccttagatattgtatttttcctgaacttcagtttcttcatctttggaatgggaggaacaacagtgcctgtttgatagaattgctatgaagattagatgtgataatgtgtatgaagcgctgagctaaccatgaggcccatggtaagctcaatcagtgttgctattgtaaattagagttctatttctaatcagagggtgagcctataccttaatataaaatatatatagcataaatataagatataaaggtttttttttcctttgaggacaataaaagcagggtaggacattatctggaatcagcatcccaagtcaaaactgcattattttaaaactgcccttaacaaagacattctaagcagagaaggattgctatactatttaatatcagcctgaggaatcttttcaaaagagctaatagatcctgtcatggaaatagatgaaaggaaatgcaaaaaaagtgggaggagtaggggtctgcgataggtgccaaaccacctggatcattttctggtgggagagagggatctttagactaaattgccatcaatatttttattttaaaatttaatctcatttttggtctcttacctataattatttacgaccttatgtttcactggatgcaagaagtattcttaccaagtcaaaaagctagtcacaggataagagacaggaacagtggacggcccagagaatgactgtgcgagggttagggtgcttgcgtggatctttgatacccagccttgctctcatcagtgcgttgcctaatggacagcagttccagggggaccccattctaaagatctagagaaaatggagggctacttatccagttttgaatccccattttctccattaggatctcccaacatattgggccactatccaagggttagagggaggaggctgagatggaagcaggggttgttttctgatctctgtggcctggtgttccttaagctcatttccctcagagctggggcctatgctgatgtcagctgttgtccagaagctttaattgaggagatacaaagctagtcatgccttctcggtgttggtttctttgcaaagacaaatctgctaacttcatattcacagtgtgaagtccctttgctggccatcagcaagattgggctcctgaactgttaggaatatttaaatatgtttttcctttcatttcccccttacagtatcctttcagtaacctcaaacttgccctacaaaagctgaagcaagaagaaggaaaatccagagagctcaagcaggtatttaaagctgctgactctaagcacacaaatatggtggattataatacattcaggtaagccatattctgctaacaatcacctgttttcccctcaaggttgtccaaagaacagagagaactatttctttcctaatcagttaactattttttattaggaattggcatttctttgagtttgtattattttgtggtaaagttttggccacgaatactctagtaaatgttacgaatttacatataaaaggagtttgtacatgagaacagagggacaagagcatagaaagtcagctggtcacattgtcttatgaatcaggaggttgaaggatcagcagaatgccaggaatgatgcatctgagtgagaaagacagaaaaaagcaccgctaagagcacgtcctccctaccaaaatctgggggacaaaggagggacatctccaggaatgtgatgaagttggaaaatagtaaaaacttcaccgattatcagagcaaaggtgatatgtatgcatctgtgtatacatgtgcttacacacatatgtgtattctgaaagacatgaaaatataggaatcgagggaaaaatatatgacagtagttggaaatattataacaaatcatgattaagattttctctaaggtgaagctgaattctgggactatccagtggctgaccgaggcaaatttccaaacagcagaaacacagggaaattcaaattcagggtctagtacaatcgtgagacttcttaggctgaaaacaaagtgaatggagcatttaggagaataaattaaatcatggatggaggacaaaggggactttctctttaggctgagaattctggctcctgacaacgatagtggctgaaagctatatagtaaactccgcttgatgcagtcaagatgtgggctgagaaatgaggaagtgagcccaggagagggtagcagggaggtctttccaactttgtgtctgcagtcgcctattgcatcactacctggtggcctggagcccaccattaggcccagagtgtcccaagagctcatttgttgttttaacaaagctcttttgtgtctccaaaatgttctttggagagaagcagtcagaggacatatttttattgtttagaattcccaaccttctgggatcaataagaatttatagttctttgttattgttcatagtcacatacacatgttcatagtgttttggaaaataaatggagacagtaaagagcagagacaattacacaggccatgggctaatggaaggcagtggaggtgaaagcaagaaatttccatcagaaatgagggagtggtttcgttttattatttgtgtccttttacaaaagcatccatttttccagcactcgcaaagtctattggaaacactttagtgagtttatagggctttttgggaagcacttaggccaggcaggcgatccaaggaggaaaagttgctttgcagatggaggcctgaccctaattgtgggtgggataaagggccactacgctgtgattggaggggtggcctcaaggagctgcatgctctaaaagaaggacctccccgtcccagaaattccttaaaatgaaactcagatcaggtttcgcctggcttgaaaaatccttcagtggcttgccattgtcctcacaataagatccaaacatttgactgcagccagcaaggccttgagtgatgtgagtctgtttgtatttccagtgtcatcacctctttttctgcagccctgtcttttggccttactgactgtctttcggtttctcaaacacatcaagctctttcctgtctctgagcctatgcacaccaagttccctctgcctgaaatgcagtcaccaccatcctctgcatggcacactctaggactcatctcaaatgccaactcccagaggggctttcattcagaggggctttctagatcctatctagagtagatcacctgctgttattcttagccacttgtttatatttttcacagcacttagcacaacttgcagttattttatttagagatctgtttacttgggggtggggtatctatgtgtatgtgctgtgtgtgtcttctcctattcgaatgtgagctttctgagggtggggaactcaatggtgttgttccctgcagcatcccctactgctgggctcaatacatatagttactaaatgaaataatgaaccactagagttgttcctgggggttctagtttggaggtgatggcatggccttcaaatgagagcgtagaccaagagtctagatgtctcaatccatatgacatgcttggtgccggatgctgagccctctgtgcttggggctgctcatttgtgctcagcccacaaatggtccctgcaccttgtcttcagccccatcttatgcttttcaaactctttgagcaaagaaaaaggaactacatagcccgtgtctatcacatcataccctaattcaattctttgctcagtgcttttactagctaatattttcctttcattatgtatgcgtatgtgtgtgtgtgtttgtgtgtgtgtgtgtattctgactctcctcatcagaatataacctctttgagggcagggaccttctctttcttgttttctgctttagccttatgacttatttcagtgtctggcaaacaatagggtgttaataaatactagttgaatgggtacattttttttttgtttagtgtttaatatgcctcagatgaaataattctctgagataattctctgcttttgtgtcttttgtgttctaccttctctcttttctcttctccttccttccttccttccttcttctttttctttttcttttttttattatactttaaattctggggtacatgtgcagaacgtgcaggtttgttacctaggtatacacgtgccatggtggtttgctgcacccatcaacccatcatctacattacgtatttctcctgatgctatccctcccctaggtcccgaccccccgacaggccccggtgtatgatgttcccctccctgtgtacatgtgttctgaatgtgtacattttatctagccctcactgctttggctttgacctgtaggctgattgtgtccatgctagttcttcaagctcagacctttctcctgagctataaacctggaaacacgaatacctctgggacgtttccccctcgcatgtctcttaggcatcccagaaataactttccctaacttgacctcattttcttctttcataaagtagcagctaggagactgtatcctgataaaggccatcatgggcatccccaagagtccagaccaggtgttggctttgtgtctcccctctcccctctctcgacctctcccactcaccctttggaattatacgtcttgaactacctctgggaactttcccttctttacatctgcagcttcacggttgtagttcagcttttcatcactgtttacttggaccctctggagagcagtgtaactgatctctttttcttaactctcatcctgcaaagttttgccagagtgaccttcctaaactctgatcggatcattcttctgctcttaaccctgcatcagtgtgtcacatgagtttgcctacctttagctccgtatttccatctcactagaagaatacttttgtagaagccaccatgtattgagcacttactgggggctaagcatcgtgctaaatgctttatacctactcttcactggtagcctcctgtcaagttgttacttgtttgcttccctgcctccacatcagctcctgccaagtgcaatagatgtttgctgaataatttaatgaacgatcctatttctcaaggaacgttcagtctaaagcttgcagcaatcaagtaaataattgatttccttgcaccagggaagggccatctggctcttacttagggaagtaaggagaagctaggcctgatcctcactagccaagtaacttgggcaactcacttcacctacctgtatctcactcatttgttcatatattggtctctgaggtcccttctaggctctgacaactggaaactctgaaaatgtaagtttataatattcttgtaaaatgttctcttttcaaatttgtacattgagatagtagagaagagcagaggcaagcaaaggcaggactgcagcataggcctatgggcttggcctctgtggccctgactctcttctgcttagatacctggcactctcagcatacacctggggcttcggggcccagacctgctgctctgggcagtggtccaagcccccagcattgccctttttctcagagatgtgcatctcctctcagaaaaactttgagggtaggagctgataaactacctctgtataaggtgccatggtcaataatggattaatgtgtgggcctctcggagatatttgcctcagaatagacctgatggaatgcagggacaggcagccatcaggaaacagaagtagggaatggtttttgttttttttttttttaatttttttatttgggtagggaacatttctcttttgccttgtgggaattcaccacttctgcttctgtttcattgatcctctttagaatctttttggcatggtctatcagattcgcctgtgagagctgctgatcgttatccaagagagtgcagataacctttcttagagccttaggatagatacctggtggcagtggtgggcagatttcagcagggagcagggcagggactaagcttggcagggctagtatttcatgcagttgggaacataggcagggtggggcttcccagtgagggccctggactctgaaccacaggcagcagcagcagcagcagcagcactgagagcccaatgccaaggaagatgtggtcagtccatctctctggccacctccctgagccttgatctacccatcagagatgacacctggccccatgtagcctgtgtgtattttggttagctgagtgcttgtctcttctctccacctggggaagctctcagagggcagggcccatgcctggttcactcttgtgtctttcccagatgcctccagaacccagtgtatcagacctcaatgaacatagtgaattattacagattttttcttcaggtccccgttatcagttgcagagtcagtagctctcctgtgaacatccatgtaataaattccttctaagatttagaacctcaaggagattttctcccttgtaaaactaaaattcttcctaaaagaggtaatataatagaaatagttcttatcactggttttggagttggcaaacccagatctagctcttggctctcttgtttaccagcttagtggccttggggaagctgctgaataattttttcatctgtaaaatggggatagtaatacataggacacagctgttgtgatgaatacatttgatactgatattaaaattcttattgtagctgactagtgcatggtggatactcagaaagtgaaaatgctttatcccaatagttgtgaactggtgtcaccaacaacagtaataggaaggtacatcttgtttccagtatttcaataagctttatatttactcatggtgggggtcattcaaaacattctttaataaatgaggttgaaagagaaactctaaaaacttgtaggccttgaagatggaaaataataaacatcattgttggtggaccaaggctgggaaacattaatataatctaccctattgctgtcctttacttcacggaagcaaattgtaaatttagtgcttagaacatggtaatgatctcatcctgatttatctaggacaattatctctccttttatatggttttgccctatttttatttggactactctgtgtacattgctattggtgttttttattgtaagcaatctagcatcttttaaggaagccactagtctatgaatctatatgaacaaaagcaaaaacaaagacaaataaaatcccaaagcactcaaacataggttcttatcatgaactaaatagattcttggacagtattcatagcctgtcttcaaaatggaaatttccatatatgtttttgaaaacagcattttgaactttcctaaaagcattaaatataaataatgtgatgttgtagaaagaatgctagcctgggaatcaaaaagatggagatctttgatttgattctgtcactgtctggtggtggtgtttgtattggtgagggcttagttttaaaaaggaatatcctctctggctagttaagcaaaaaaaaaaggaatttattaaaaggagcctgggtggttcacagtgtctttggaagggctggagaaacaagctcaaggctgaactataggaacagtgcccaaaacagggctgtagaacttgtctgatgagaaaatgacctctgttaccaccacccatgactcattgctgcacttgcattgctgccaagaacttgattttaccacagccataactaccactatttctggcaatcgtcctttaccacccctgaaggctgggctcctttgacaccaaacgtggcccaccctgagctgcttttcttctgttaatcccttctgaggcacagtcttaagtaagcttccctgattggtagagagcctgggtcacctgcatatttctaactgcaaggaagtctgggaaattgagctctgacctctatgttggggtggtaggaaacttacgtgggaatttccccaaatatagaaaggctatttaaaagatagcctttgtagaaagtttcagttagacaggatgaataagttctggagatctggagatctattgtacatcatggtgactatagtgaataatgatgtattatatacttggattgctaagagagtagctcttaaatgttctcaccacaaaaaaataagcatgtgaggtgatagatatgtgagttagcttgagttaattacttctaaatgtatacctgtatcaaaacattacattatgtgctgtaaatatatacaattttatttgtcaattatactttaataaagctggggggaaattgaataaataaaagatacccttttcatttgccatgaatattgcagggatagtaaatccaaaccaacatgagccaaacagggaacacgaatatatgttgacaacagggacaaagcacctacctagttttagtactttgaaaatattgttttgactcgccaagcagctaaacaagaggcaaagccctcccctacgcttggctacttttgcaatctctgatgaacttttctgagtttccattgccttaaatgaaggtattggattaaaaacaggtttataggttgaaagctggcagttatattttgtatggcttttgtttaatgtttttaaaattgggagtttaaacctaagaatatatatatctggtgcctcttggaaaatagaaattggacccacatttctctatggcaacaatcttttgggggtgaatggcacttgccctccttagatagagcctgttctctgcatttcttctcagtttctacaagtccttattgtctcacgctaaggcactttctcctatttatcttacatacctaccccagtaggtactagactaggtaattcttggattagatcatataaggcacctcccagacataaaattccattattttgttactctaggtattgtggaaataggcatttaggaatcactgtataaatagttcaaaatagaactgaagactaattttttaaaattagaatccaaatatgattgtatacttggaaaatccaaaggaatcaattttaaaatggttggaactattaagagtattcaggaaagtagctaaatataagaaagctatatatagaacaatagctttactttatatcagcaataactagttaagaagtgttctgaaaaggggaatactatttgctgtagcaacaaaaatgaaatatctgggaataaattggacaagaagcgtgagactaaaatgaatgcaatttttaaacttgatatctctgaatgggaagacaatattgtgaaaattctaattttccaaatttatagatttgaagcaattccaatcagaattgcacagcaggtttttgctcttgctgttgttagatttggttttgtttaacagggttaagggagataaattgactgattgattatgaaggttcatcaagaagaataaggggttgagaatatccaagaaaatgttgaaaagaatattaaaatgtagatactagaaaggtatatgatttacatacatttgaaaacattttctagcagagaaacaaaaatatcagtgaaatacagtgtagagtctatagaagagctatttttatgaactttcgtataagtatggagaacatttcaaatcagtagagaaagaatggattattaataaagatttggtgacagtcaactagaaaatgcctttatacgcttattttgtggtggagcacagtttccaaaagccataaaggaaagattatattgactacagaagaattttatctctctctatggcaaaagctatcacaaacttaaaagacaagggacagactaagagaaaatatttataaccagtgtaagagccaggggattaacattaagtacttaagaactcctataaaatcaacacacaaaaatggatcaaaggcaggaatagttcacagaagaaatacaaatagtctttaaacctatgaaaagatgcccaataatgacacaaactgaaacaatgatgaaatattatttccacttactatattggcaacatttaaaaagaataatataactgactccaggtgaacatgtgtggtaacaggtactctcattttccactgataggagtttaaattggttcagcattttggagggcaatcggcagaatgtgtctaatgtttagactcttacctggtagttgcacttgtagaaattttttatttgaaaaaaatttggacaggtggattgataaatatatgtgtatgtgcatgcacaatatttattgcagcaaattttgtaatagtaaacatttagaaaaataaaatgcccaacaatagggaaatagttggatatattctattgcattaatttcagacaatattttttagccattagaaagaggtagaccacataggcataacagaaaaaatgtttgatgtatcagttaggattgtctaagtaatgctgcagtaacaacaacccctgaacctcagggaattaaaccaaccaaggtttattgtttgctgactttatgtatccattgtggttgtcaggggaattttgttcatagtagccactcagagactgaggctgacagaatagccactaccttgaatgttcgcagtcacattgccataaaggaaagagaattttggagggtcaagtacaacaaattcttacttggcaagaaatacatatcatttacactctcaatttattggctagcactagtcacaggaccccactcatgtgctcagaagaaggagggaaaccagatcttggtgaacagctatgagtggctaccacatatgtgttgtgctgttttgtagataaagcaaaatccagaagtgtgttaatatcctacttatgccaaaaatgtaaaagttgtgtgtgcatgtatatttatataaatatttcaaggaatgtatatcctttgaagaaatgctagcaggctacacacgaagctattagtggagtatgcttcattccttgatttttacttttttttacaatgagcaattattttttaaaacttcaatttaaataaaataaaacccaaacaaataaaaccaaaaagcctgggaaaagagcttatggaacagtttttcagaaagaacattttttatttcttgcttcagtttccagaaacagctaatggcagatgctggcagaatgttctgagcaaaagtcaagaggcttggaatcatagagtagcgcacaggttgctgtagttggtactctacctactctgattattgactacagtcacataattgtaatgtgcttacttaaaattcttattttaggggccacaatattttatgtttctgcaattacaaagtttcagaggtttaaagttaagttttgagatgaaatagtttttataattttcaaattcctatcaaattagcatgttttacccattcattttctccaacattttatgaaaattttaaaacatccagaaaatttggcaagattaaacagtggacaccccatatatccaccactgtgccattaacctcttaactttacttgctttgtcacacatctctccatttatacattcttatatccatctattaacccatcttaattttcgtgcatttcaaagaaaatcatagacatcagttacctccctctaaatattttagcatgcttactatttatttatagtttttcttttgatgtgaaatttatgttcaataaaatgcacaaactttatacatttgctgggttttgacaaatgtacgcttgtgcaacccagatccctactaacacatagaacattaccatcactccagaaagttccctcatgctccatcctagtcaattcctgtgcacatctgccattcaagaggtaactactgttctgatatatatttttttcactttaggtgctttttttttttttttaactataggtggtttttctctgttctagaatttcatatgaacggaattatacagtgtgtactcttttgtgacttctttcgttcagtatgattttgagattcattcgtattatagagtgtatcactaattcctttatattactgagtagcattcaattgtatgaatataccaccatttgttgattcattcccctgccaaagggtacctgggttgttttcgatttggggctaatatgaataaacctggtctgaatattcctggcacaaatatttttgtaaacatgtgtttttatttctcttggttatacctaggaatggaattgctgggtcatacataaagtaagtgtgtgtttagtgttttgagaaactgccagaccttttaccaaagtggttgtatcagtttacatttccaagtccacattgtcagtcttttatggttgttgctttctgtgatctgtttaagatgccttcggctggctcaaagtcgcctaggatagtctcctatgtttccctctaatagctttatggttttagctttcgcttttaagtctatgacttatctcaaattaaattttgtatatggtgtgaagtagggatcaaggttcatcttaaattcttaaaatgcttatttggaattcttatattatgggccagcatattttatattaaagtaaagaaaaaaataattctagagctttagaatataattttgaaatggaagagttttcataattttcaaattcttatttaattactgatgtcttacccatactttttttttcttattctatggtatagttttgactgttaaaatatcaaaatctcctttgcaaaggaagctaaaatactggccttttatgttttctcaaatcttatagttttcaatagtttccttatgtaatacattcgtatttcttaaaaattgaagtattctcactaaaataatatcttagttaactgaggaatgctggataccaatgatcttattaactgaaagaaactgtatactacacatatagtggattatattttccaaagattgcttcaacagtatctcctatccaacatgctcccctataatgtgaacttgacccttcttcttctgagggatagggctatgtcatttccccttgaatcttttttaatttacaatttcttatttttgtgggtacatagtaggtgtatatatttatgggatacctgaaatgttttgatacaggcatgcaatgcataataatcacatcatggaaaatggggcatcctcttaagcatttaacctttgtgttacaaacagtctaatgacactctaagttattttaaagtatgcagttaaattgttattgactatggtcaccctgctctgctatcaaatactatcattcattctatttttttttgtacccattaaccatccccacctgctgccctcccctctcccccactaccctttctagcctctctgataagcatccttctactctctatctccatgggtttgcttgttttgacttgtagatcccacaaataagtgagaacatgtgatgtttgtcttttgtgcctggcttatttcacttaacataatgagcaaatttcattctttttttttgactgaatagtactccattgtgtatgagtaccacgttttccttatttacttacctattggtggacacttaggttgcttccaaatcttggctattgtgaacagagctgcaacaaacatgaaagtgcagatatctcttcgatatactgatttcttttcttttggatatatacccagcagtgagattgctggatcacatggtagctctgtttttagttttttgagaaacctccaaactgttctccacagtggttatactaatttacattcccaccagcagtgtacaagggttctcttttctccacatcctctccagcatttgttattgcctgtctctcgggatatgagccattttaactgggataagatgatatctcattgtacttttgatttgcatttatctgatgatcaatgatgttgagcatcttttcatatgcctgtttgccatttgtatgtcttcttttgagaaatgtgtattcaaattttttgcccatttataaatcatattattagattttttccctataaagttgtttgagctttttatatattctggttattaatcccttgtcagatgggtagtttgtagatattttctcccattctgtggcttgtctcttcactttgttgattgtttcctttgttgtgcagaagctttttaacttgatgtgatcccatttgcccatttttgctgtagttgcctgtgcttgtggggtattacccaagaaatctttgccccgactgatgtcctggagagtttcccaatgttttcttgtagtagtttcatggtttgaggtcttagatttaagtctttaatacattttgattttatttttgatttgatatggtgagagataggggtctcatttcattcttttgtatatggatatccagttttcctagcaccatttattgatgagactatcttttccccagtgtatgatcttggcacctcccttgaatctcgagtgggcttgtgactcatatgtaaccaatagaatatgacagaagtaatgctgcgtggcttccgaggccaagctagaaaagatgcaggttgtgcattgtctgctgtgacacttccctttggagtctgagctactgtgtgtgtaagaggtcctgccaccttgaggctactatgctatgaagaagcccaggctacacggagaaaccaaccacatgtgggtggtaatttgattgagagccccagctgatatctcagctaatggcccttgtcaggcataattcaagcctccagttatagaatcttccaagttaaagctccagacattcttctgtgctctgtctgaattgctcactctcagaaaccatgaaaatagcaaaatgggtgttattagctgttaatttttagggtagtttgttaaaaagcaatattaactggaacagcatacatcaatgccttccagggaaatgaaatactgaaactatactgcattcacacgaagtatttaatttttggttatttggagaacaatttgatatcctttagtgcctcaaggtcatggctttccagttttttaaatgcaggggtagagaaatctcatgccacatcttggaagaatctcttgttcaaagaccttcccttgtcatacatataattaaaatgcagaaatatgtatgtatgtggatatatatagatacatacacacgttgtgtgtgtgtgtgtgcacgtcaagattctttgtacttgtgtcttccatctgcaagaacagtagggaatctcttcctttcacctgaattcagccaggtgaggtggaggcttttgtgagtttagatgtgttttccatccaaagaagatgtggtctccttttctaagaccacatttgatttttaaaattttaatttaaattatattcatatacaataagattcacttttttggtgtacagttctggttgtgatgccttcctagagttgtgtaactgccaccacaataaagatacaaaacaattctatcacgctgccttcccccttccaacacccaccacccccccccaatggaagtatgctttctcttgagtaaacacataggagttgaatgtcttgatcatatggtaggtgtatgtttaaactttgtaagaaactatcatttttttgttttgttttagaggttttctacatctttcattagatttttccctagatatttgatatttttggtgctattgagtggcataatttttagtggttgctctagagtttgcaatatacatttacaactaatccgaattgtatcagtcagttctcacagtgctatgaataactacccgagactgggtcatttatgaagaaaagaggtttaattgacttacagttttgcaggctatacaggaaacatgactgggaggccttaggaaatttacagtcatggcggaaggtgaacgggaagcaagaaccttcttcacagggtggcaggaaagagagagagagcaagcggggaagtgccacatgcttttagaccatcacatctcttgagaactcactatcatgagaacagcatgagggaaatctgcccccatgatgtaattacctcccaccagttccctctcccaacactggggattataattcaacataagatttgggtggggacacagaaccaaaccacatcataagttcagtttcagataacactatactagcttcaccagtaggcaagtactccttcccccttctcttgtatcattgctgtcattcatttcacttacatataagcatacataagtataaaaccatgcataatcaaatacattgttgctattatttgaacaaacttttatgatagatcacttaagaataagataaataaaagcttttacttaccttcacttactccttctctaatgcactatctttccttatgtagatctaagatttttacctagagaattcctttctcttcgaagagcttcttttaacatttcttgcaaggcaggtctactggcaacaaactccctccatgtttgctgagaaagtctttatttctccttcactttcaaaggaaaaatttcacaggatacagaattttagattggtggtctttttctctcaacactttaaatatttcagtgtactctcttcttgcttgcatggtgtctgagaagtcagatgtaattcttacctttgctcctctatgggtaagatttttttccctgtagcttctttcaagatattttctttaactttcatttcctacagtttgaatgtgaaatgcctaggtgcagtatttttgttttggtttggttttggtttgttttgttttcggcatttatcgtgtctgttgttctctgagtttcctggatctgtgatttggtgtctgacattaatttagggaatttctcaatcattacttattcaaatatttctgctgttcttttctctctttcttctccttctagtattcccattacctatttgttacactttttgtagttgtcccacagttcttggatgttctgttccattttttttgtcagtcttttctctctttgcattttggttttggaagtttcttttgacataacctcaaggtctgagattctcatccatgtccagtttactaccccattgaaagtattcttcatttctgttatagttgtaaaccaaaaataaaattcaaagccccccacctcatctggatggatccctcctctcagcaagggtatccctgagggactaacttgagggactagttcaggccatgatgaggggcaggggtcagacatacttcattataccctcttcccttttggaattactgatagaacatactcttcaagtctgatgagaaacgtgtacaatctattctctctgaagcctgctacctggagccttcatctgcatgataaaactttggtctccacaataccctatcattgtaacccagacatttctttctattgattcaggatcttgagataataacgtacctctttgaactaattgcccatcagaaaattttaaaatctacctataacctagaagccctcgccctttgagttgtcctgccttttcagaccaaacaagtatatcttacatgtatttgattgatgtcttacgtctcctttaagtatataaaactaggctgtgcctcaaccatcttgggcatatgttctcaggatctcctgggggctgtgtcacgggccactggtcactcatatttggctcagataaatctcttcaaatattatagaatttgacgctttttatcgacatagtgttgttgattgctagcatttctttttgagtttttcttagaatgtccatctctctgcttacattattcatctattcttgcatattgtctaatttttccactgtaactcatagcatattaattatggttgtttgttttaaattcctggtctgataattccaacttctctgccatatctgagtctgattctgatgctttgtattttcaaactttttttttttttttttgccttttagcataccttgtaatattttgttgaaagccagacatgatgtactgggtgaaaggaactgtgggccaggcacagtggctcacacctgtaatcccagcactttgggaagccatggtgggcggatcccttgaggttaggagtttgagaccagcctggccaacatggtgaaacgctgtctctactaaaaataaaaaaaaaatcagcctggcatggtggctcatgcctgtaatcccagctactccggaggctgaggcgggagaatcactggaacccaggaggcagaggttgtagtgagcctaggtcgcgccactgcactccagcctgggtgatagagtgagactctgtctcaaaaaaataaattaaaaaaataaataaaaggaactgtggcaagtaggcctttagtgatgtgatggtaaggtgtgggggcagggaaatattctctagtcctctgattaggtctcagtcttttagtgagcctgtgcccttggactgtgaagtaccctcagttcctcccctcccctccccctactctagatgggaccggatgtctggaggggactggagtcacgtatttcccttcccccatgtggatggctagagcaggctgcagttgagtgttacccttaccccaggttgttaggctctgataaaaccccagtaggtcaggctcgtggttactttgctactctctctgccagaagtctgaggacatattttttaatagtcactgtgagaacctgatggagatcgtggaggtaaaattcacttaagtgcaggctcgccgcccaacccccctcatccactttgactgggccgtctacagttttaaaaggcattaaaattttttttgttcttttttagaagtggggtcttgttacattgcccagactggattcaaactcctgggcttaagcagtcctcccacctcagcctctcaagtagctggcattactgtgtcctgagacctcaagagtttttatccctcaggcatatccacattgagcctccagcattccaattacagtccagagttttctacctcagtactggttcccacagaggtttctgctccagtaaattgtgattctctgtatgttcctgcttgtctgtctaattttggggacagtgatttgccctgtgacttcacttctctgacagatctaagaagagttcttgatttttcagtttgttctttttttttttttttttttgagagggagtcttgctctgtcgcccaggctggagtggcgtgatctcggctgactgcaagctccacctcccggcttcacgccgttctcgtacctcagcctccccagtagctgggactactggtgcccgccaccacgcccagctaattttttgtattttttttgtatgtttagtagagacagggtttcaccatgttagccaggatggtctcgatctcctgatctcatgatctgcccgcctcggcctcccaaagtgctgggattacaggcttgagccactgagcccggccaatctttttttattttttcttttttacttcccaaactgttttttgtttgtttgagatggagtctcactctgtcgcccaggctggagtgcaatggtgcgatctcagctcattgcaacctctgcctcctgggttcaagtgattctcctgtctcagcctcccaagtagatggaactacaggtgcacaccaccacgcctggctaatttttgtatttttagtaaagatggggtttcactatattggtcaggctggtcttgaactcctgacctcaggttatccacccacctcagcctcccaaagtgctgagattacaggcgtgagccactgccctggcctccaaactgttttttaaagtagttgtatatttttcttttttaccaggagtcttggagagttctagtacctttacatgcttatcaccctcgatatggtctgtcttttaaattttagctatcctaatagctgtgtagtagtatctcattgtgattttgatttgcatttccctaatgattaataatgttgaacatcttttcttcacttatttgccatccatatatctggtgaactacctattcaagccttttgtccatttttagtttctcttattactgaattttgagagttttaaaagtatgtgctggataccagacctttatcagatatatgattgccaaatgttttctatttctctgtggattttattcttttaaaagtgtctttcaaagagcaaaagttttaaattctgattaagtcctatttatcagtttttgcttctatggattatgcattggtattgtatctaagaagtcttggcctaatccaaggccacacaggtttcttttctactgtattttcctctagaagcattatcatttcagattttatatttagggctatgatccactttgagttaatttttgtatgggtgtgaagtatttgttaaaaagttttgctcgtttgcacatggatatgcaattttttttagcatcatttgttgaaaagactatcctttctccactgaattgccttgttgaaaatcagttgtccatgtaggaatgggcctatttctggactctattctgtccaattgacgtatttgtccattttgataccaataccgcattttcttgattactgtagctttgtaagtcttgaaatctgatagtgttagtgctccaactttgttcttctttttcaaagttattttggctctatactggatctttgtattttcttttgaactttggtatcagcttgtcaatttctataacaaaccctgttgggattttgattgagattgcattgactctacagataaatttggagacaatattgagccttttgactaatgaacgtggtatgtctctccatttattttggatttcctttatctcagaaatgctttataacagtggtcctcaacctttttggcaccaggggccggtttcatgaaagacagtttctccataggcccaggtgtcatggctgggagatggtttcaggatgattcaaacacattacattcattgcacagtttatttctattattattacattataatatataataattaatgtagaatcagtaggagccctgagcttgttttcctgcaactagagggtcccatctgggagtgatgggagtcagtaacaaatcatcaggcattggattctcataagtagcgtgcaacctagatccctcgcatgcacagttcacgaaaaggtttgcactcctatgataatctaatgttgctgctcatctgataggaggcagagctccggcagtaatgcgagcaatggggagtggctgtaagtacagatgaagattcgcttgctctcttgcccacccactgctcatctcctgctgtgcagcccagttcctaacaggccacggactggtaccagcccgtggcctgggggttggggacccctactttatagtttttagggtatagttcttgcacatctcgtgtcaagcttgtcactaaatattttatttttgatgttttcataaatataatgttttaaaatttagtttcttattgtatattgctaatatatagaaataagattgatatttgtatattgatcttatattctgcaacattgctaaactcatttattagttctggtaattttcctttttattctatcagtttttctacgctgatggtcctgtcgtctgtgaataaagacattttcacttctttattttcagtctggattcctttgatttctttttgcttgctttattgcactggctaaaagtgccaatatggtgtgttttgtcacatgaaagctttaaatttttaattatacttgaatttgtccatcttttcctttatgggtttgtgaattttgcattctgtttaagaaattatgtatgccccacatatatgaagatattcttctccattttcttctaaaagttacaacatttgccttccacatttgggtcttaaattaatctaagattaatttttgtgtctaggttaacacacacacacacacacacacacacacacacacacacacacacacacacacacacacacacacacagattgccaatcaacccagtatcatgcattgtctgtcctttccccagtggtttgtactgatacatctgacatatgtcatggacccatatccatatgaattggtttctaagccctccaattttattaagtttgtttgcttgtctattcttaaatcagtattatctgttttcatttattactatagcatcatgatatgtcacgatgaaatataagcagggtaagttctaatttttcttcagatttgtcctatttgcagacttttaattttccatatgaactttatgaccactttttctagctctatgaaaaggtgattgtattttgattggaattgtgttgaatttatacattaatttgaggacagaaatttttcacaaaaattttagattcagaaggtacatgtgcaggtttgttacatgtgtattttgcataatgctggggtctgggcttctactgaccttgtcacccaaatagtgaacatagtactcaataggtagcttttcaaccctcgccttcctccctttctccccctttttggagtcctcagtgtctataatttccatctttatgtatgtgtgtacgttttgtttagctcccacttacaagtgacaatatgtggtatttgattttctgtttctgcatcaattcacttaagataatggcctctagctgcatccatgttgctgcataggacatgatttcactcttttatttatggctgcagagtattccatggtgtatatgtaccacactttcttgcactgatatgtttataaaagtggtattcacaataaccacctcatagaatcaacctaggtgcccatcaacagtggactggataaagaaaatgtagatttcttttcctttgggtagatacccaataatgggattgctgggttaaatggcagttctatttttagttatttgagaaatctccaaactgctttccacaggagctgaactaatttacattcccaccaacagtgtataagcattcccttttctctgcatccttgccagcatctgttattttttgactttttaatagccattctgactggcgtgagatgatatcttatttgattttaatttgccttcctgtgacaattagtgatgctgagcattttttcatgtttgttggctgcttttatgtctgtctgcttttgagaagtgtctgttcatgttctttgcccactttcgaatgttgttgttgttgttgttgttgttgatttaagtttagattctgtatattagtcctttagtcaggttcatagtttgcaaatattatctcccattctgtgggttgtctgtttactccattgacagtttcttttgctgtgcagaagctctttagtttgattaagtcccgtttgtcaatttttggttttgttacatttgcttttgaggtcttcaatataaattctttgcctaggcaaatgtccagaagaatttttcctaggttttcatagttttaggtcttacatttaagcctttcttttttttttttttagagacggagtctcactctgtcacccaggctggagtacagtggcatgatctcagctcaccgtaacctccgcctctcgggctcaagcagttctcctacctcagcctcctgagtagctgggattaaaggcacatgccaccatgcccagctaacttttctatttttgtggagacggagtttcaccatgttggccaggctggttttgaactcctggcctcaggtgatctgcccacctctgcctcccagagtgttgggattataggagtgagccactgagcccagccacatttaagtctttaatccatttttagttcatttttgtatataatgagagttagggatccaattcatgtctagccagttttcccagcaccatttattgaagagggtgtcctttctctattgtttatttttgtcagctttgtcaaagatcagttggttgtgggtatgtggctttatttctgagttctctattcttttccattgatctattagtacgtgcctattttttgtacaagtaccatgctgttttggttactatagccttgtagtattgtttgaagttgggtaatgtgatggctctggctttgttatttttgcttaggtttactttggcttttgaggctcttttttggttccatatgaattttagaaatgtgttttttctaattctgtgaaaaaaatgacattggtaatttgataggaattgcattgaatctgtagattgctttgggcagtatggatattttaatgatgttgattcttacaatccatgagcatgggatgtttttccatttgcttgtgtcatctatgatttctttcagcagtgtttcatagttctacttgtaggggtatctcaccctttgattaggtgtattcctaggtattttattttttgtgtctattgtaaatgggatttcattcttcattggttctcagcttgaatgttattggtgtatagaaatgctactaatatttgtgcagtgattttgtatcctgaaactttactgaagtcatttttcatgtctaggagtctattggaggaacctttggagttttttaggtgtagaatcacattattggcaaacagagatgatttgactgcctttttccctatttggatgccttttatttctttctcttgcttgattgccctggctaggacttccaatactatattgaatagaagtggagagagcggacatacttgtcttgttgcagttattaggggaaatgctgccaacttttgtcttcctgatgtaagcctttagcactataaactttcctctgaacactgcttttactgtatcccacaggttttggtatgttgtgtctctgttttcatttgtttcaaataattttttgctttaatttcattgtttacctaaaagtcattcaggagcaagttgtttagtttccatgtatttgtgtggttttgtgagttcctcttggtactggtttctaattttattccactgtggtccaagaagatgcttagtagaattttgatatttttgaatttattgagacttatgactgagcacgtggtcaatcttagagactattccatgtgcagatgagaaggatgtatattctgtggttattgggtggagtattctgtagatgtctattaggtccatttggtcagaagtccaacttaagtgcagagtttccttgttagttttctgcctcagtgatctgtctagtcctgtcaatgggatgttgaagtcctccactattattgtatggccatctatgtcttttcttaggtctagtagtaattgttttataaatctgggtgctctgatgttgagtgcatatatatttaggatagttaaatcttcttgttgaattgaacgcctcatcattatatagtgcccttctttgtccttttttaatgtcgttggtttaaagttgttgttggttttaatgttgttggttttatctgatacaaaaatagctacctctgctctattttgttttccatttgcatgatagatctttctccatccctttactttgggcctatcaatgtcattacatgtgaaatgggcctcttgaaaacaggagaaggttgggtcttgtattttttttttttaatctaatttgccattttatgtcttctatatggagcgttaaggccatttatattcaaggttagtattgatatgtgaggttttgttcctattgtagtgttgttagcaagttgctttgtagtatcaattgtgtagttgcttcataaggctctcggctttatacttatgtgtgcttttgtggtagcaagtattgttctttcatttccatgtttagaactcctttaaatatttcttgtagactggtctggtggtgattaattcccttagcatttgcttgtctggtaaagactcaccttcgtttatgaagcttagtttggtggggtatgaaattcttggcttggatttattttctttaagaaggctaaaaataggtctccaatctaggaggtctactgttagtctgatgggattccctttacaggtaatttggcccttttctctagctgcttttaaaatttttccttatgttttgacctcagatagtctgatgactatttgccatgggagtggttgtcttgtatagcattctgcagaagttctctgaatttcttgtatctgcatgttgacctctctagtgagattggggacatttttctgaattatagcctcaaatgttttccaaattgcttgctttttctccttctctctctcgaatgccagtaagtcataggttgggtcactttacataatcccatatttctcaaaggttttattcatttttaaaattatttttccttattttgtgtgactgggttaacttggaagaccagtctttgacctctgaaattctttcttctacttgatctagtctattgtcaaggcttcaaactatattttgaaattcctgtagtgaacttttcaattccaaaagttctgtttggttctttcttaatatatctatttcatctatttcatctgtcatttcctggatcatttttctgttttatttgtgctggatttcaactttctcttggatattgttgagtttccttgcaatccatattttgaattctttatctgtcatttcagacatttcaatctggttaggatccattgctagggagctagtgtgatcctttgcaggtgagaaaacactctggttttctgtactgccagagttcttgtgctgattcctgattccttctcatctgaggctgttgctgctttttttttttttttttttgggtttgctaccatttcagagggctttctaaaaatttgttattcttttttcctttgagggtatgactgtggtgtatgttgtgtgtgattgattggcttcatttctgggtgctttcagggggcaaagctctgtacagtttccttggttgcagataggttctgtgctgtggctttgtcagatgctgcttattgtagcaatgcatttttgtttggtggtgcagttcaggctgcagtacagtagatggtgcttaagagtagcagccagtaggtaggttggtgtccaggtggacgcacctgccctgatggtggtggcaggaagagatgatggtgtgctaaagtcttgggggaccaggcttggtggctcacacctgtaatcccatattttaggaggccaaggtaggagaattacttgaggccaggagttcaaagccagcctggttaacatagtgagactgaatctctacgaaagaaaaatttaaaaattagctgagtgtggtagtgtgcacctgtagttccagatactggggaggctgaggtgggaggattgcttcaacccaggagttcaagactgcagtgaaccatgaccatatgactgcattccagtctgggcaacagatcgagactctatctcaaataaaaaaatgaagtctcagaggcgggtttggggagtgcaccagcttcttgtcttagaccagcaggaatccatctattttcttatcatgtcactctcaagggctcacgacctgtttgtaaaggttttgtcctttggttctatgccactgtgtggctgtgggccgtgaatccacctttctgatggctaccattagagtgggggtcagagcagagcctattcccacagtccagggagggtaactccgaggtctgtccttcattgctagggcactgccattctgtttagggagggggagttgggccttacactttgtgcaagcacaagcagacacgggcttgctttcagtggggttggagctgtgggaaaagtgtgacaagcactttctttcagtgtgagctcactttcagcaggggtagagctgctagaaaagcatgaaaagtgctttctttcagtgtgctctgactttcattggaggtagagcttccagaaaagtgtgaaaattgctttctttcagtgcacattcactttcagggggaatggagccaccggaaaagtgtgaacagtgctttctttcagtgcatgctcatggggccctggtggggagatctgctgctgcatctccaacagttactgggagaggggtgagagatgacccgtctctccatatctgttcccaggcatcagtaatatccccttcagcagttggtaccacacccatcattcctttgtcccaaagaatgctttggtgggctgtgctcccctctcccttaggggcagcccacaatgaaattagatctccaggggacctactggtcccctgtgcttgccaaaattatagtgggttctggggtatgtttgtgggttgtctggtggtgcagtggctcaaatgcagaggatccctgggcacggcagtgacaccacatgtgcacagctggtgtggtaccctccatctcagtttcagtctgagagttgtgtggcatggctgcacaagctggccacctgattttggggacataatttctgtcactttgaaatagaaacttctcatccataaatataatgtatcttgttttataatactttatagttttattgttattgtagctggtatatttactttaaaattacattttctagttggtggtatgtatgaatgctattgttttcgtttgtttgtttgttttttgtttttgatggaatcttgctctgtcgcccaggctggagtgcaatggagcgatctccgctcactacagcctccgccacccgggttcaaacaattctctgcctcagcctcccgagtagctggaattacaggtgcccaccaccacgcccggctgatttttgtatttttagtagatacggggtttcaccatcttgccaggctggtcttggactcctgaccttgtgatccacccgattatgttttgtatattgatctcattttattttttgaattctcagagtctgtagattcttttggattttaattttggaccatattatataaactataaataatgacagatttgcttcttcctttctaatccttatgatttttttttctatttttattatattggctagggcctacaatgcaacatgtgagtagtaatagcagatctccttgtctttttccttaccttacaaaagatatttttactaagtacttagcttattatgagtttttggtagatgcagatattttctttaggattttcacatctttattcataaaggagataggtctatactttttctttctcataccacctttgtccatgtcaaatgtgtgttttataattgcttcataagatgagtttcagaacattcactgtttcttaaagcagcttgtaaaatgtaggtattgtcagtttttttaaggttttgtgtaagttgtctgtaaaaccatatggcccttccttttttcagtgggtagatttttaatgattcacttcctctaatacattttattccagatttctatttcttcttgagttggttttgaaaattatgtagcttctagaaactttcccatttcacctaattttaaattttttataacctttttagtcctgttactgttgatttgtaccttttcaaaaaatcaattttactagagttgttttttagatttttttaaacaaccaaattttaacttgttaaccctctttttaaactttgttttctatttcattaattcatcaatttgtattcttatttttatcatgttgttctttgtactttttctgtgtttattttctaacttcttgacttgaatatgtgtttcactgattttcagtgtttcttttctaagaaatgcacttaaggctttaatttgccttctgagtattactttagctgtggtgtatttagtgtttattatcctccatatataaatattttctagtattatttcttttttgaccaattagttatttaaaagtttgttttgacatttccatatgtgtatgaagttactctcatttggttcttaatttctctttttattacgtttagttagagaacattgtctgcatcttcttaattctttgatatttaatgagacttgcttcataaacctgggaattaagtcttaatttctgcaatgcatgtatttttctcttacttttgaagtttaaacgggtacataattctagatttaactattttcctttgatcttttgaagatactctattgtcttttgcctccattgttggtacgtctcttgttaatataattgttcctttgtagtcataagcctttattccctctggctgtctttctttgtttttggtgttctgcagttttattacaatgcatcttgggactatttataattcttcagtttgagaattattctgagccattatctcttcaaataacttctcttgttcattttgcctgttttccttctcaaactctcaacctgttcttgttatctcttaatatcctgtcaaactcctcttttttctccatgtcttttgatctttcattcttttcatttatttttcattctgtgctgctacatttctggaattttccttaaatctcccatctagttcattgattcagtgactctgccttcttattctttaagtactatttaattgttgtgtttcatgtttccatccttttccgtagcatcttgttcttttcttatggcttctctgtgttttatctctttaataattttaaacatcataatttcatggttcattactgatttttgttctattgtcccaaattcatggaatgccaatttttctgttatatctgctgacttagggtggattgtttccttttgttttctgagctcatcttaaattggactttcttcctccacttcattgttcctttgttgcttgggttgaccatttagagtagtttttaaaaaatcttttattttgaactaattgtagacttacagaaaatttaccaaactagagttcccatatttccctcacccagctttttctatgttaacatcttaccacagtgtaattattaaacccaaacaattaacactgggacagttctacagactaaaaacttcatttgaattttaccaatttttcactgtcatttttctgtcccaggatcctatccaggatcccacattgcatttagtagttgtttcatgttagtcttctgtggtctgtaacagttcctcaacctttctttgtcttttatgaccttgatactttttaagaatagtggtcaattattttgtagaatgttgttcaatttggagttgtctgatgttttctcatagttggactgagattatacacttttggaaagaataccacagaaatgatgttgtctccttcttagaacatcatatcaagtggttcatgatgtcagtatgtcttactactggtgatgttggccttgatcacttgattcaggtaatgtctgccagctttctccattggaaagttactatctttccttttgcatttaataaataccttgaaagagacactttgagactatgcaaaccctactttttctcaaactcacctgctaattttagcatctggcaatagaactctttgagtaattttgattttacctttccaggctagcttataaactggtctaatttcatgttaattttgatgttaattaattgccttggaacatggattagtcaattttttttgttataaaggaatacctgaggctgggtaatgtataaagaaaaaatgttaattttggattatggatcttcagactgtacacgaagtgtggtgctagcatctgcctctggtgagagctcaggaagcttacaatcagggcagaaagcaaagtggggagctggcatattacatggtaagagggagcaagagagagagtaaggaggtgtcaacttcttttaaacaagcagatctcatgtgatctcagagcgagagctcactcatcactgaggggatggcgctgagccattcatgagggatctgcctccatgatccaaatccctcccaccaggccccacctccaacgctggggattacctttcaatgtgagatttggaggggacaaacatgtgaactgtatcagagctttatatagtaagtgggcaaaataaatttatactccaaattcttattaggtggaatattggctttgatttctatcagataacttattttttttatacctagagactcagcagagaaaagcctcattgtcatctctcttgtccaatgggtagaatttattaattctttcacttcacttgcagccttttacagttctagctttatgcataggtttaatgtgtaggagttcccaattgctactctcctggactggaggtcttgtcgtttgtgccctggtgagtgttaaaaaatctaagctcttacctgctaaagggtttgatcccacttcctccccaccccaactacctctcatcctgctgccacctattagcttgttcatcttcctctctggctgtcagctacctcttcgcgttggtacctggggacatttctctctgttttcacaagctcagccaggagtgtgagttttaattgctgcctagtctaccattttgccatgcacaatctctctcccatgccataagactctctaaaattacactggggaaaatactgactagacacgttattattagggaatgtcactttattattaatacctatgctaaactggatttggctgtgatcgtataggcctagttaaaatcagttccactatttaaaaatcttaatcacgcttaggcttctctctttctatttttgaagcacatccattcttataaccttgaattttatgggacgctagaaaaaattattggcattttagaataaataaatcatataatgttgtgccaaaacagatagagtgtttcttatgtttctaaagagtggaaaaaggaccaactctttttctggggttttatatatacatatatatttatattgtgtttattttatttctttttccatgattatattcttgtggaaatgaggaaatcattaacagtgaaactactgtttcatccaaaatacagtgttctaatggtctgttttctaaatgaagcttctatgaataaaagcaaggccgctatatagccatttagttgctaacaaatgacctggttagtgccacccatgatttcttctttaattagattgcaaattttgtgtttaaaaatgggagcagtaagtaaatgctaatttgtagttcctcagagggagaattgtgatgtaaaaattaggatataaaatgagaggataccgcagggcaggagggtaatggcacttgggccaccatagggcaggccctgccaggctgcttttcattcaagtaaattttgcaactcaaagtactgggtatggaaggcgtgccacatagtacagtgtttaatcatgtaagtttattctttcttcattcaataaacatatattgtgcatgtgctctgtattgggtcccatggtggatgacagaggctcagaggtgaatgagctgccttttgggagtgccagcctcatctgtggccttggactgctggttctgtgctgccaatctgggtcactctcttcccacaccattttggaggggtctctcctttgctgtccagtttcttctgcctgctcctgaagacatgaactaaattatatttcttctcttaagatgttccttaccactgcagctcagagtaatccttgcctctttgaactcattttatttatggctggtgctacccagcatatctttttattcccacatgcatgttagttggagaatagatggatgaatgaatgaatgaatgaatgaatgaacgaacaaaggtggtgccttttgtttggattcaattttcactcacttaataggatcatattgacagggcattcctagacttattttgacctttcttgaaggatgattcattctaccacttactaataattatcataaaagctaacatttatatgcttgctgcttaccatgtgacaaatgttgcactaaatgctttctacatattaactcatttactcctcacagcaatcctacaaagtgggcactattattattcccattttgcagatgaggaaactaagaagcagagaggttaaggaatgtacccagaattacatattaagttgcagagctgggatttgcatcaggcagtctagcaatttcatcatgagttatgatttagaatcaaactagctaaggttgacaattcattctgcctctctaatgcttcaggttcatcatctgtgaaatgagaatcattcaatggcttactgggggcgttagatgaattaacatatgctaaacactaagccagcaaatatccatgacattagttccatccatttcttcttaccactggccacatggaacttacactctgggtctagaaagcatgtatgtgcccctggatggctcagcagctgtctccaccaactttgagatcttggctgtgattaaaatctttttccttgactctgccttttctggaagactgtcttttggaatgggggcagttggggtaggattaaaaaacactttctgagtaaataccccttcagttcttcttctcactattgtatgtatttttatatttatctattttgccttgtttcagaaatggatttaaggtaagctagaaagatgtagacagttctgtaggataaaatgaatatgcaaatgctaaaaataaaagaaaaaatataagtaagaaagaacaggggagccaggagtggggctggcatacagagtatatttacaggctctgaagttagaggcatttactagcagtcagccacaggcctggctctgagcttcctagaagtcagtgcaaaataggagaccatgatccgttcatggtgttcataaagtaactataagctgggtgtggtggctcatgcctgtagtctcagcactgtggcaggccaaggctggtggaccacttgagcccaggaatttctgaccaacctgggcaacatggtgaaaccccatctctactagaaatataaaaattagctggacatggtggtgcacacctgtggtccctgctactagggaggctgaggtgggaggatcacctgaacctggggaggtcgaggctgcagggagctgtgatcacaccactatactcttaagttggacaacagagtgagaccctgtctcaaaaaacaagcaaacaaacaaaaaacaaaacccaaaacacaaaaaacataaagcaacaataagccaagttgcttaggaaaagggatcctaatgcagagtgcaagaaagactttctccactggccactcacagaaaggactctctggtaggtgagtggtggtctcagtagcgtgccccaggatacccagggataaggtccaggtggctgtttctgacagtattccctagaagaaaataatatcattccatcagaatactgttcagtcaaattaattctgccagaggcatcatgtgccatagcccaggtgtccaactttctgaggtccagcttaacactggggtttgaagctgcctcatagcactggggtgtgaaggagaagaaagtgcaagaaggcaggacttaggagagtacatcaataatcaattgccagaattttgatgtgtaataaatgacctgaaaatatctgtcacgcaaaaaaacaaaaaaacaaaacagcaacaacaacaaaaaaaaccacacacacacacatttatttagcttacaggtccgtgggttggctgagggttcgttgatctgagctgggcccagctgggatggctctgttccatatgtctgtcattctccttcaaggagcagcgggctaacccaagtatgtcgttctcatggcgatggcagaagtgcagtcagagtgggaaacaagaagacctcttgaggcctaggcgcagaactggcacactttgacttccacgtcattctcttggccagaacaagtcctgtggctgaccccattgtcaaagagcaggaaaattgtgcccctttagagagtgcgacagcaaagcgacacaggaaagggcatagatagtgagagggaagtattgaaggcaatgatgcagtatcccacagagggaatggaaatgactttgagaaaagctcactgccccttgaggcacagaggcccctgcactggttgtatctgctgccaccatgcaggtttaattctctgctgcaggaggcttgggcatgaagtggctctggttgtggctagttaccattgcgacaaatgagctcagtacaaattggaccctgcgagtcaccattctgtaacctgggtagaactttgtgccagcgcctgctagagttgcacactccctccctaagctggaatatggctgggcccctgaagtggcagggaagttagggttataactgacaaccagctcccccattttgtttgatcttaattaattcgtgctcattttcccttatattttataagtagaaatgtgaaacacttactaggtgagcatatttactttattttttgatttagagccacctaagttttagagatgaagctatcagcatatggatttcttccattactttgaaaactgctatatttggtactgatgttctgtggttacatgctgggatccattacatagaatttaagcacagaatgtttaaaacaaggagccaagaacaagttctcattacattatctggattgaaaatgatttcttactgacattgtaaagtttcaaaattccagccactgtcaaaacgtagccgggtaacttgcctagatcgtgtctatgacttctaattcagatttgattctcagcccagtactaccctctcccaagctcagaattcttcatagaagacccaaaacaaataaaaaaaataagccacaacaataaaatgtaagaaattctcctacttcatattctgggaaggaagtaaatcattttattcattgatggacttatatttctgcctttttgatttatttcctggcatgagagacctagttgccttaatgactatttgtcaattgagcacaagcccaaaagtctaccctggggcttccatgtgagtcagtggtcccagggaagagccactgctaagggttgtgctggttgtgaactacacaactctggaacactgcatggagagcctctcttggaattcctttgtcagtggttggggtattggcacaaggctcccagcttttactctgcccctcatcctcttcttttcctaccaaacacctatcccaaatttggcttcttggtctctaaatcaaaagctggtctttcttcctccctcccaccctccttccctaaataaatgtgccctcttttcatagtgatttggcacatttatttagaatggatacaactaggtccctcctttccttgaccactctccctctgtctacacacacggacacatacacatgcatgccatctgtgacagagcctgtggaatttgtgaaccatagccacacaccaatgcccaggactgttctagagacctctttgtaaagttgcatgagcagagaaaaactaaaccacgcagtacaggagaatccatacagattctgaaaagttagttttattgtgtgaaaagttagtttttgtttgtttgttgtaggaaactagttacgttattgtaaatcaaaagtatctgagaaaggtctcaatcaatttagaaagtttattttgccagggttagggacatgcccatgacagagcctgaggaggtcccgagacatgtgcccaacgtagatcagggcacagcttggtttatgtattttagggggacttcagacttcaataaatatatgtaagatgtacattggtttggtccaggaaggtgggacaatttgaaggggtcgggggtggggcaggctttcgggtcataggtagatttaaagatgttctgattagcaatgggttgaaagagttattaccaatagaaaggattgtctgtgtcattataaggggttgtgaagaccaaggttttactatgcagatgaagcctccaggtaacaggcttcagagagaatagattgtacatgtttctaatggacttaaaaagtctgttctatcagtaattccacaagggaggagggtataatgaagcatgtctggctcccacttcccatcatggcttgaactagtttttcaggttaactttggaatgcccttggttgagaggaggggtccattcagatggttggggggccttagaattttcattatggtcacaacaaaatatatcagagtctcagcaggagcaagccattttgagaagcaagcagagaagaataaagaaagatgtgttagaacttacaaaacacattttctgaattaaaaattagaggcactaatagaaaactggacactgcagaaacttggtaataaaccagagaactatctttagaaataccaccaagagagcaaaattagagagggattgaaacaatgacaaagaagagagcagaaacgaaggtagagagagaactaaataaatgtagctaaagtgataatcaaagatcgtttaaaaaaatcattttctaagctaagtaaagtatttgtaaattgagagaattcactctgatccctgtaaaatatacgaaaagagatcattaaatataccttggtaaaaatgtgaaaggtcacatagaagactcttataagaatcaaagcaaacttatccaaaacaacgcttaaaaataccaccatcaccagcagaaccaatgccctaaaacccaaaaagatatgacctcaggcaatacacagaggcagtggttaaatcttcagtgctttgagggtaaacaagttgttttttatgcatggaacaatagaaatgttttttaaacctttaagaaaacaaaaaatatctagtttctttagtaaattgctcaaagtaatatattaccttaataacttaatccagaatatgatgaaaaaatcaaaattaagaactcaggaggacatcatatctttaaaaattggagcagcattggacattaaaacaggttttatacacacacacacacacacacacacacacacacacttacatatgtgaattcaaagtgaaaacattgtttcaaagaggtgaatgacatgattagaaaaattaaaaaggtagatgaaatgggttatgccacagataaaataaccgaaactcagaaagagagtataaggagactaagggcaaaattcctcatattttatctgaatgtgaaatcatatttcatccatttctttgataattaggtatatataggtttaagatattttagggcaatttcaagttaatcaagaataagattctaaatggaattgcagaacctaagagcaaaccaaatatggtaaatccttaatgctgtcaataggttctcagaaactgactttaggtgaatgacatataatgaaaccaattttcccttaggctaattgagataaacgaaagttaagttcctatagcatatttctgttcacaaaaaaatcaccaaacttctaaataaagacccaaacacttataatatcaagcattgaaataaatgggagttatacatacatttaagaaagatgaacagactgggtgcagtgactcatgcctgtaatcccagcatgttgggaggccgaagcaggtggatcacctaaggtcaggagttcgagaccagcctggccaacatggtgaaaccccatctctacgaaaaatacaaaaaattagctgggtgtggtggcgggcgcctgtaattccagctactcgggagactgaggcaggagaatcgcttaaacccgggaggcggaggttacagtgagctgagatcacaccattgcactccagcctgggcaacaagagtaaaactctgtctcaaaaaaaaaaattaataaaaacaagacaatgatttacccaattttggtgaatcagtgagtggcagtggccatggtagtgatgggttaaatcagggaataaatgtttgcagagcgaacattgtaaggagcatcttttcccaccttgcagttcaaaaccaaaaaatcacaagtagagcaggcttgctgagcgcttttgtcccatgtcctttattgtcatagacttgatgagtttttattttatcctaatttgtattcatttgttcattcattttccaatgtgcttattccagttcaaggtcatgggtggctggagcctgtcccagcagctcagggtacaaggtgggaaccagccctggacaggacaccatcccatcgcagggtgcactcacacatccacactcagtcacactgggaccatatagacatgccagctcacctcatgtgcacagctttgggatgtgagaagaaaccagagaaaacccacgcagacatggagagaaagtacaaacttcatgcagacagtggctccagcctggagccatttttttttccccatcaacattatcataaaatgatgttgaacgaggtgatgttattcaagaacctgctatatttaggatgtattgcaaaagacaagaagcaatcaatataaggtaatggtaacaatacatgaaaaactgaaaacacaaaataagatgacaggaggaaaaaaaatcaagagaaatcctcaccataaatgtgaactcttgattgcccttgaaccatcatgacacattccacctgctccagattggcatatggtcacctctcttttactttctcatttaattcccatttgccatattatcttgaattcctcttggagatttgtcagtatattcttgagacctgttctcttttcctttgcccttcattgtccaggaaccccagggatgcttattttgtctggagagggccagaccactgccaaacactgctgctgtggcttcttgttgtcaccaggctgctgtggaagacaggttctgccaggctggtggacactaccaggatgactttaccgggcagaaggtcatgggctgggttttgctgttgttttaagttgagagagacatgaacattctatatgctgaaaggaaaggaccaataaggtccaaaaggaaagggccaatagaaatcaaagtcacagatgacaaactggacaactgatggatcagtgagtagctgaggatgaagaagcagttaaggagggaatcaaggcctagttgtacctgtttccactctccacaatggatatttcagactttctcactcttaagctcctaacttcaccattttcctccaatttataacagaaaacctcatctccaggttaatagagcatatagagatcctgagatgtaaaccacacccatgcccccacatccacaacttgccattcctttttcatctcggtagaaaaggtgtccctcctgctgtccaaagctggcttccatgatggccctgtctccctaacactcaacaagaggcttagagtccatccgaggcccagcacattcaattctagtttatgcctctgagctgcaacctcagcccattctcttcatctcagatgcactcccgtgcctacctctgcattgcttcctgagtggtggggcttctaactctctgctcatattgctgtcttgctcaacacccttcaagagattccgttcaccaaaagaagaaaacctgggtatcctacatggcgtacacatgcatctctcatgagtgggccccgcctgccagctctctaatttatctcttgctttgttttcactatattctaatcattctatgaatcctgaacattgtggttcaattcttggctccaccacttactattaatagtactgtgcccttgggcaatctgttaaagctctctgggccttagttcctcatcagtaaaatgggaaccaagttcctactgaaaggattgtcatgagggttaaatgagtctatgtgtgtgaagcagatcaatgtttgacataccctgagctcttgataatgtctgtgcctgttattaacactttgtacagcttctcagatgtattataccatcttcttgccctctttttttttttttttttttttgagatagagtcttgcttcgttgtcgcccaggctggagtgcagtgacacaatctcagcttactgcaacctccgcctcccgggttcaagcaattctcctgcctcagcctccgaagtatctgggactacaggtgtgcaccatcatgcccggctaatttttttttatttttagtagagatggggtttcaccatgttggccaggctagtctcaaactcctgacctcaagtgatccacctgcctcagcatcccaaagtgctgggattacaggtgcgatccactgcacctggctcttcttgccctctttgaatctttgaggatatgattctttctcccattcctctcagcctccttcccttactcagctcccacttctctggttggcagattgcctttcatcttcaagatctgctctgctaccacctctgctgtgaagctttcctggatttctcgctatatgtatacacatgtcagactggatgaggggtactttctcggagcttttggacatatctttattgtagcactttttctgcttccttgacttggctttccctctagtctgtgattaattctaggatgtagatattgagggttgggggtcaaatctggtccattcctctattattctccatcatttgacataaagttaatatttaatcagtgtttattgaatgaatgaatgaatggattcatggacaagggatgtgtgcagacagaacacaatagaagaaatatttcttaacaaataaggggaagagatgttgaagtttattagtaatcaaattattattgattaaaatgagacatcatttttacttgttgaattaggaaacactttttatggccaggcgtggtggttcatgcctataatcccagctttggggaggctgaggcaggcagatggcttgagcccaggagtttgaaaccagcctgggcaaaacaaaaagccaaccccgtctctaccaaaaaaaaaaaaaattgctgggcgtggtggcacatacctcacatacctgcagtccccagatactcgggaggctgaggtgggaggatcacttgatcccaggaggcagaggttgcagtgagctgagattgcaccactccactccagcctgggtgacagagcgagactctgttaaagaaagaaaaaaaaaaaacacttttttttttcttttacttctgtctccatgtttgacaggaaacactttttgaaaggatattccattgctgtgggctcttactcattgctgatggaagggtaaaagcagcttagtactatgtgtcaagacctttttaagtgttagtttcttttaaatttttattttacttttcatttttgagacactttctcactctgtcacccaggctggagtgcagtggtactatcataactcactgaagcctcaaactcctggactcaagcgattctcctgcctctcagcctcccaagtagctgggactgcaggcacacaccacaatgtcgagctaatttttaaaaatgtctgtagagacggggtcttgctatgttgcctaagctggtcaaatgttcctttgttttgcctcactaattgtacttctggaacaccatccgaagggaataattgtaaatacagacaaatgtttatgcatatagatgctcattatggcattatttatataaaaatttggaaaaaaaatgtgtaatatctagtaacagaagtatggtttagcattttggtttcagaatagtctgtaataacatggaaatgtattagttaagtgaaaaagatgaaaatatgttcacacctattaagaaaaagacaaatgcccatgcatagtaaagagactgcagaggagtgtaccaggatgtttacttggttatatttcggtggcaggggtgtgtatggtttttcttttcttttttttccttgcttttgcatattatccaaaatctctataattggaaatgtattacttttataatggagtaaagcccatatatatatatatataccattttgttttcctttgagacatggtcttgttctgtcacccaggctggcatacagcagaacgatcatagctcactacaactttgacctccttggctcaaatgatcctcctacctcagcctcccgagtagctgggattacaggcatgtgctaccatgcctggttaattttttaacgttttggtagagatggagtctcattaggtttcccaggttggccttgaactcttggcttcaagtcaccctcccaccttggcctcccaagttgctagaattacaggcaagaaactctgtgcctggaccaaattttatattttaaagtgtgtgttcaaaaagatttaagaatctgattatattactgataattatttgatatgagtaagtcttgaattactaaattgattacaagcaccaatatggcacagactgtgttttgtattcaaccgttgtgtgatcaataagtacctgtgggtttatttggaggcacccttcatcatgtaaggccccctgattgtcacagagctcaccatggtcttgtaggcctctaaaccatcgggaaccaagtgagagacagttaaaaacaaaaagccaaacaggtgggatttgcttggagacaaataatccctgaacataaagtgggtgttaatgcaaaggcagtggtagaaaacgaagaactctgcttgtaaatgaaatgaatattcactccttctgcttaccttgcaagttaagcaccagtattgagacttcatttgctgttaccagttaccaaaaatgttgacacaatttaaaaaacaaaactaaaaaacccactgttgctttagcttgtttaaatgcatattgtaccaaatcatggaagaattatagatgaacattttaaaggatttctaaaattatacttctatgaagaatagactgttaatggtatacagcaattactcttaactgcatgaaaatatctcattttgtttggctacacttaaacaggcctgaagtctagtgcaccaagacatactgaatttcaaactaaataaattaaaattaccatgtacattccactacatgtcaaaacaggaaaaaccatagtattatagttgatatgaaatgaagattacatacaacagtaatacagagaaaacatgaagctgcttatatttatttggaataagacaacagggtcaatgattttcactgcagatgtacttctttttgagaaaatatatccaaaaatcaatttacaaggcagatgaatttggctgttattatttatagtatgtaaatattatttagtttcaaaaggatttctttaaaccaggcacagtggctcacacctgtaaccccagcactttgggaggccaaagtgagaggatcacttgagcctaggagaccaacctgggcaacatagcaagaccccatctctacaagaaagtttaaaaattagccaagcgtggtagtgcacacctgtggagctagctacttgggaggctaaggtgggaggatcgcttgagctcaggagttcgtggttgcagtgagccatgatcacaccactgcactccagcctgggtgcagagtgagaccctgcctcttaaaaaaaaaaagacttattatttatttcagggttcagtgtccttgcttgtcattaagaacttgacagaaattagaggaatttaaagctatgatgttagatgccactgccaatttaaaatgaccaagataaagatagcatatctttatatgtaatagagagtgaaagagggcatctaattcaatttctaaaaattaagtatttatggagcatttcagatctattcattgtataaaagaaggcacacctggagtttatttctttagcactttagacttactcctgaatatgactgtttaaaacaagcatgccattttcattttatatcctgcagatagattctaaggtttcagagtcatcaaaagcatttcacatttctccaaggtaaacttacttaagagaagtagtgctttcagtttaatacaacttgaaattatctccattgtgagatggtgaaaatagtaaaaattgctattatttattgagcattcatagttcaaggtactatgctgaatgctttttatatcttgctaacttaatcctcatttttcatttattcatcagactacttgttatagagagcttactatgtgccaggggctacttaaggtgtcacagattcaacaatgaacaaaatagacaaaaaccactactctctgtggatcttacactccagtgggggtgggagggagataaagactatcttcaaaataagtaattatataccgttagagtgtgatgaatgacactgaggaaaagaaagcaggaaaagggttaagaagtgccagagttgtagaggaaggggtcacactttttttttttttttttttttgagatggaattttgctcttattgcccaggctggagtgcaatggcgcaatctcagctcactgcaacctctgccttccaggttcaagcgattcttctgcctcagtctcccaagtagctgggactacaggcgtgcgccaccatgcccgactaatttttgtatttttagtagagacggggttttgccatgttggccaggctgatctcgaacccctgacctcaggtgatctgccggcctcagcctcccaaagtgctgggattacaagtgtgagccaccacgcccggccagaggtcacacttttaagaaggttggccagagaaggcctcacagagaagctgacatctaacaagataagatgccctacaggaggtgaaggaacagcctatgtgactgtcttggggaagaacattccattctaggtagagagaacagcaagtacaaaggctctgaagttgaaatgtgcctggcttgttttaggcaggtgtagagggaaagatgggaagggttgtagaggatgaattcctagcgacagcagaggaggggccagatcatgtcaggccttgtaagccatcatgaggcttttgagttctactttgagagagatggcaagccctcacagggttttgaacaggcaaagaacatgatctgacttctgttttaacatatcatcctggcttctataggaaaataaaattctatttcacaagtggtcttgtcccatttcacagataaggaactcagattcagagaagttgagtagtttaccacagttcccatttactggtgaattagtgggactagaattttaatacaagtcaatgtaatttgaaagctcacactttttccagactgcctcccaattgaaaacaagcttgtgacctcagctggagtagttttctgatagtctacagtgaccccttttttctccttttctgtggaattccttggtctctcttgtgaggccaccatgttgcataactccggaagaaaccacttataccacaagtctataactgtgccctctggaggtgggcagtatgaagccaaagtgaagtggccatctatggtggccttgttctccagtgaagttgaagagctttgtacatggcattaaactctagttaggcctgtagcaaaacctgtttggtcagacatttgtgtcggactctctgtgatgtattttgccatctctccttcctctgacacatattctaccagctatctctaccaccctctactgtctggcaatactctagctgcagattcaacaatgaacaaaaccacagtatgacatgctggaatataagtggcaatacggcaagggtttctgttttgtatgggcagcttaggcccacaagtgtaagagaaagcctgagggagggtaggatatgagcaggtgtgcacagcttctgattacaggaagcaaaacacattttatttgatgaatatcaaattgaaagtaatgagaaagggtgctacctaattgtcgccaaaactgctgcttggcttaatttaggctcaactagattttgttgtatgccttagggtctgaaggcttaggctcttgagcccttgtttatgctaaaactaatttttttttagtttatttgaaagacattgcttagactttaatgattcaacaagtaagaaaataccctgagattcagagctttaaaaggaaattttgattcaccattttactggatgactttaatggaattatgtcttataaagctgtttagcgtttcatgtttcagaattctgcgtagaattctcaataccctagagcatcttggcatttttttgagtcttatgactttagttactaaagtcaagagaaaatcatggcagcatcctttataagattaactaaataatactgtgatattatagtattatactgtataaaatattagtgccaggaatgtagtgcaatgttggctaaaggcaaaggtaacttgctatctaaatcttcaagattagtaataataatcacaggacacaagatcaatacaatcacaactgccttttaaaatacatttttatttccctgaaatgattggtcaagaagtactgagatcagattttgctatcagatcttatttcaagttcagtatgacattttaggtgaggaagggctatgcttgatggaagttgtacctatgtttttgtggctgctgctaagcaaaaatagagtgtgcagaaagcagtttggcagtgccacaataggttaaacagacttacctgtgactgaggagtttcactccttggtatatataccccaaagaattgaaaacaggtgtttacacaaaacttgtacacagattttcatagcagcactattcacaacagccaaaggtggaagtaacccacatgtccatgtatgtatgagtggataaacaaagtatggcacattcatataatgaacaatagtatgatagtacaatgaataagaattcagccgtgaaaaacgatgaagtcctgatacatgctactacatggatgaaccttgaaaatgtgctgagagaacccaatcacaaaagaatacatattacataattccatttatataaaatatccagaagctggcaaatctgtagagatagcagattctgggtagggaggagggttaggaaggagggaggaaagaggcgtggttgctcaatgggtatgagctttctttggggtgatggaaatgtttcagaactagatagaggtggtggttatacaacattgtgaatatactaaatgtcacaaatggcaaattttatgctatgtgtattttaccacaatgaaaaatggaatgtgtgacttttgatttttaattctttgtgaatcctactaaagtttaacagggcgggggtgagtcctgaaaaacacacttgtggcaaatgcggggcagagtggtgacagccatctgaggtctgcaaggtgaggcttgtacatcctgattgagatccctcgtgcaggaacctgcctcatgtgggcacagcagccacacaggcagccgctccaggagcccctgatgccctgcagggctgttggcagtttcaaatatagcacagcttctttgaaactttcatgtaaagtcatgtaaaaccggaatactgagctgtttaaaacccaagcatacagaaacccagcagatataaattttaactgcagtgaagccaggataatttcagtttatccaatgaaaaggaaaataaacttttatgttctggtggtgctataataagtttagtgaaaggtgtatggaaagtttctagttattgctccacatgttctttttccttgtccttgggagcatgccactttctcttcttcacgccatattctactctcaaaaggaaatgctttcgaatgtttttttttttcatttagacaatgaaaataatatttgattattacaaaaattcagaaaaaatggaaatacttttttttaaaagacatctcaaccattcaggataatactattgatgttttggcatgcatccttctggtcttatttctatgaccatatgtgcacctgtatcttgatttttcactgggatcatactacatttatcaacatagcatggacatctatcctaccaataaatatcaatcaataccatacttttctttttttagagatggggtctttgtctgtcactcatgctggagtgcagtggtatgatcatagctcactgcagcctcaaactcctaaacttcaagtgatcttcctgcctcagcttcccaagtagctgggattataggtgcatgccaccatgcccagctatttttttttttttttggtagagatgggttctcactatgttgccctgactggagtacagtggcatggtcatagctcactgcagcctcaaactgctgggctgaagcaatcctacctcagcctcccagacatcataacttcttttttttaacttttagatttattcttctataatcttcttttttatttttatttatttatttatttatttgagacagagtctcactctgtcacccaggctggagtgcagtggcatgatctcagctaccgcaacctctgcctgttgggttcaagtgattcctgtgcctcagcctcctgagtacctgggattacaggtgtgtgccaccatgcccagctaatttttgtatttttagtagagatagggtttcaccatgtgccaggctgatctcaactcctgacctcaggcgatctgcccatcttggcctccctaagtgccgggattacgagcgtgagccaccacgcctggccccaaacataatgcttttaatggtgatgtagtgttccattttacacacatggcatgactgtttcttgatcagcgttgtagaggagccaggggctttccttggagtggctcttttgtggttacttagccctctgtcagagatggttggtgactcaggttttctgaaattattttctcttactttttaaataatgattagtgatagccctcaaagcagagatgatggacaataaaggcaataaaggtccataaaaaatcagcttaaaccccactgcctttaggcacatttcctgactgagccccactccatcagttctctccgccttctgtgtcccaacagaagagggatagagtagtaggcaagagcatgagctttagagccagactacacgggttcacattctggcttttgtgacattaggcaggttatttaacatttctgtgcctcagttcacatctgtacagtggggataatagtagcaccacctcctaggctagatgccagaagtccctgctagcacaggacctggcacacagtactcaacaaatggcagaggttattgctattactcagtttatttaagtggccctaccagtttgtggctttgaaagatcatctatatgcttggacagtgcaaatagataacagattctgaaaagttcaaatgccagagagccttttacagtgttttccatatagcgagcctcctgccaatattactaattgattgtctgacctgacttgctgaaattctgggatcatcttggttggattttgcattcatttcccattaaaaatacaaaagcaaaaccaaatttaaacaaaacaaaacaacccaggaaacttgagaagtagatgtagattaaatgaatttcctttagataggtcaacatcaatgctgtgggctttcctagactctatggaaattcttgactaggagaatctagaattattagatgataatgtccagaaatacctaaaagaactgaaagcatttattctgaaagacctctttctagcagaaggccaaataaaattttctattcccttgtttattcaggattcttgggaactgaattatttccagtaaataaattttctagacagtggaagcttattcctgtaaccaccataacattttgcattttaatcattttgatataattctgtctggtgtatgctgcttagtttatggctttcatacagagttacattgaaaacaattcagccaatttgctaggccttgagtcgtcttcattgatatgttgttgtttagttttttttttttagctctgcctaataatctcagtaccatttgccttctaaagatgcagacagctgtacgcttacataggtcttttaacttttcatttttttttctcttgtttttttttctcactgccagggtgtgtccagttttactttttattacagaaatgtgcatgattgctttccccatcccaaaacacctttctaatttattaacttacaaattttatgtcccaggaaaccagaaacccaagcctgttactattttgtgtaaggaagattaataggcattgaataaagtcatgtacttagtaataggttttttgaccattcaaagcctttaaaaatttacttcctggttgcaggctgttatttggtaggtgtttaactctgggcaaaatgccattttatttataagctacagtgcctatgattttccattctggcattggtgccttcctgctgctcccaaattaagaagagaaattaagttaaaaaaatcacatgacctctgtacagttggtaaaagttttgtaaaatggaatttggatcttttaaatagaaggagatgtaaaatactgtattcttagatatcagtttataaatgtttttccatttttattacagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaagtaagcttttgttttattgattctaatcatttacatttctgtgaacctgagtaatgaaggaatttctattttatcaaaaagtgcaaaaagaaaatagacatgtgtcatcatactcatactctactatttagcacaaacaccttaaatcattttcggagaagtatttaggtacagatatttcccagtgatggagagcttgtgtgtgtgtgtgtgtgtgtgtgtgtgtgtgtgtgtgtgatatggcatctggccctgtcgcccaggctagagtgcagtggcgcaacctcggctcactgcaacctccacctcccaggttcaagagagtctcctgcctcagcctcctgagtagttgggactacaggctcgcaccaccgcacccagctaattttttttttttttgtatttttagtagagacagggtttcaccatgttggccaggctagtcttgttgacggaataggggaggccctgtatctttgaaagaataggcttctcccttgcatgttcttttcatttgtttctagaagctttcaactgaagcatagtaaatcaaaatgttaggagggttaattctgagatgtcgtctttttacattattttagtactgatggggatttataaatgtaacttttataataaatagaaaatggaattttcaagcaaacattctgtagaatttctttgaaattatttcttcttgaaaataatgaagttcagtataagctatttcttatacattgattgtgtgcgtgttgagcttcattaagtcattgttacatacaactggatgcaaacaacttaatgtgttttttttgcattcatcttacagaccttatacagtggggagaaatataaatttactgatttcatctggaattagaaaaatcttagttcttgctctagcttctaatccgtattgctgcacaccactgccatctctcttccttgtgacttcttgccttatccccaaacttgaagtctgaacccaagtggccaactgcattccctgaatatctgtgtaggtcccatagtttgtcttagaaataatcattttttttattaatccataatgcatcctctttgagtttttataaagatggtatttttccttgactctttaagctttcccaagcttcctagaagatgtgtggcctgagttttgcatggccctggccctgccttccaccctggtgttgcccccttccccagagtgagaagtgtggccctccttcattcaaggaacacttcttaggaacaatggggctgcttgaccagatagcctgaggttcttccagatccatcaagctttgattctagatataaacattctcattgcaaagaaaagagccaactttctttcctgttggttctaattttgcccgatgcctggaaaagtgttggctgaatgagaacattggacaagaatgtctttgcccccataagactggagaaaatgacttttgggctgctctagagaaaactgctagcatctgaaaaaattgaagtgaatattgaggccccagctggggcttccaggtgataaggtttgggtccaaggaaaagaacagaaaaacaccctcaagtcatatcatacttgtgttggaggctctagatgcctgtcaaattaagagatgttttcaaatatcagaaccatttttgactagtggtcaagaatgcagatcaattacttagagcaacacttgtggctgtagccttaataggctgtactgtcaccaaccaagaatctgcatcttgaaggaaaagcctttgtaaggatggagtctggtggcctctgaaatagaaaaagttgatgaaatgaaatgtgactgttcttccttattgtgaattccaataccaattttcatacttccatgtgtacattctcaggaaacatcacaaatgtattttctttcctatagtatgtaattattactaaaggtatacaaggtatataaaagctcatttacgttgttttaatgcagaaaaaatgtattacccaccaaagacattaaaaggctgtgcaaatcctccagattacctttgagtgatgatcttctagaatccttattgtcaaggtaagttagagttccactcttgatagggattgtcctgcatagttttatttgggggaccattcctggttttacatctccctttaattacccttgatttacccttaactgttttgattatattattggtgacctgcctccatttaagtgttacagaaggaaaagtttgtcttgattttgaatgttagagagcctattacaaattattattttatctttttaacatgaatacacacttatagatccacagattcctgggacaaaatgaaatacacaactttgttggttaggaggacattagatgtaaaattcagggcaggtttttcaaagcagcagttcctgatagctatagacatgcagtaagagaacctagggttattagcatggggctctgtcctgatagagcaccagatgtaaaacatagagattatgatgctataaaatgagagcatggtgaactgctttctaaaacacatcagttctcctgttgaacctgacttttgatttcctggcatgtccctctcagccacctagactctggccatctcttatgcttcctatagcatcactcactctagctcctcctctgacttatatatcttgataattctgacattttcagctgtgttctaggcattgtgatcattgttttggatatattatctcatttactttttgagaacagcttggtgaggtcgaaactgttatccttcttatctcatacgtaaggatgctgaggtttagagagatgaggtattttgcccaaagtcacatagtgtagaagaagaagagctctgatttgaatcctgaacttttcaaatgcacatcctctgcttctaatcattttgagttactgtctacaaatagccagtagattaggatgtcttgacagttctacctcctccttactgcttgcttctactctctcctctccatttccactatcatcattcttgttctgacccacattgcttcttaaatactgcggtgccaccacattggtctttcatccaccagtgtctaaatgtttaaatccatctttacatatagcagctaagtaccttctaagagcaaaaatgtatgtcatcttattgcacttttactcacaaaccttctgtggtgtctctttgctctctaaggaaggaccagctctttaactttgaattaagctccttctccatagtggggcttagggttcgcagctggagcattgttctcaaatagggtctgaagtagggagtccttgtttgagacaaaaggagaaaccaaaggaacagataaagccaaattctatgtcagggaactagggtccaaggtatcaggagggaaacccagaagagggcaaatctagttggatgtgtatgtgcattgaatcaacctggaataattttctagattatcagttctatttgttttgttttgattttgtttttgtttaactctatttgcttttatttgctagcagccgtgtgagggatcctgccgtgaaggaactgagatgaagtaggcaggccttggactcagagttcttcacagatatcatcccccactcccaaaactccccttcctgttcccagtagtccagccacatgggccgtttagcatattacacatatacctcctgccttccccctcccccccccttttttttttggccttttcccttgctatttcatcagtaggcaatagctcccaatggttttcacttgctgaaagcttgctcttccttcaagacccatttcaagtggcaccatatccatgaagctctgttgcattcgtttggctgataatcagagtgattatctcctgctcagaattctcacagtgctatttatgtgtctctttatcccttaccttggaatgaagagttgtgacttgaacttcgattcattcagatgcagacactgcttctgtgtgatttaccacctataaataaccaatgggttgtcacatcctgacaattttacccccctcctccactcccatctcttaaattctttgagtccacttattagctgtgtgatcttgtgcaagggttttgacctgcctgaacctcagattccttatctctcgaatgacgtaacagtacctatttcctagtggttcagaggattaattgagataacatacataaagtacccagcacagtacctggtgcaaagaattgattgaggactaggagagaaatttaagtcagggaccatagaccacacactcagacttagaaatgaactggaagaaacctgtgtctttctatgtagaggaagccatgtttttcaacaattggatctgaatgcctttcacacattaagctgtcttctagtcaggaagctgtggatgtttattagattatcttttgatggtcttaaggatgagttgtcctggaaagtccagtaatgtgggagcctggcctctggaggacctacatgtttcttatccagtgctgaggccaccaagtcatcatcctctcattctctcagcagactgttttgtctttgcctttacgatttgacattaaatgcaaaaagattgtttcagaacttgcttcgaagtcatctcagtctctgaacacatctgtctccaagcccagcttagctttgaggaggtcatcccgctcagctgctaagcagaccatgttcagtctaactttgcctctaattgtgcagtgacccttctccacactcaggggaaacttcagactaatcagattagaaaatgtctcattcccattcccctctccctccaatatgccctgccatgatttgggtcacatgcttagtgttttgcatcatctctgcagattcctttcaaagactgccctaattcctaatgggcccatcagcctgcagcttacatttatattctgcattcttattgttccccacagactccacagggctttacagagccctgaccagagtctctttctgcacagccctccttatggcacgctaagccagagccccctctgacgtctacagtctcccgtgggaggcaggcatggagcttgttgattttgttcaatgcatgctcttgcccaggaatagttttacctgccttggaatggagctgggcagctgctgagcagccgtgtaaccctgctgtgtaaattcagatcaggagatgaaaaacaatatggctaaagggttggatgctttctttcacccagtaattgttacccatgtatttctcctaaccctatattttggtaccaggattttccttctactccattcccatttttcttataattcagcttgatcttttccttattatgttaacataactcaaactggaatcaggacttcaaaacctttttgtacctggttacctcagcccctgtcagtttgtgctgtgggagctggtataaggtcaccttacttaccaagcaaattcatttcattaatgcacagagcatcagacttaaatgttctatatagtggtagcgattatccattaataataggagtgatactttgtattgatgtagtgctaagggccttagaatattttgtaaatttttgagcatattaaaaggtacattttaattggcagtaggcattattcctcatttcataagtataaactctgagagtctctcactgaaagactgtgctccaggccaagatgagcctctaatggaagtagaactacaactgcctaagatactctaaacctttgcctctatctgagctcctgagggtagggactagatctcgttcatttttgcagcctcaaagacttgtcctgtgctaacgcactggacatggggtagaaaaacatgggctcggtgtccaccagagctgctcctgcctctgcaggtcaactctactgtttcctgaccatgcgattcttgggcatttactcaacccctctgagccttcatttggatattcatattcctctgtaataataagcaaaaaattctgattgttagaccataagaggtagagggaattctgaagccattccattctgtattcttcatgggactgggaaggaaagaggcagccttctcccctaattgtggccttctgaatctagacttggaataactagagattcaagtgcaactctttccccagcagctctgtcctgagctagacttttatagttggctttgggttccatggaatgccttagaactggcctcccaagagagctggtgcctcatccagaaatatcagttaaaatggaaaaagttaacagggctttaaaatcatctcattatagtctacccagccttgccccctgccctgctcccagaggcacggttagtgctcctgtgatttcacccaacaatacctggcagtgaggctgaagggcaagggctgagccatgtggtagttattgtggcagagtgtttggtgtactgatgaagttttcacagagaagccccttctctctgtctctctgtctctccctttttcctcctttgtgtgctctctcctctcactctctctgtctctttgtcagacccatccacccacccagatgctttctaccttttcaaatataaggggatttctagttgaaaagatttttcttttaaatcccaaaccatatggacaaacagagtatcgactctatgtacaggccttacctggcagctgtgacccacctcaccagagatctgtgctggagtcagaattggaatttagaggcatgactatttagagataaccagaattacttgttggcaacttgacgcagaggcccagagctccatctcttctcaagtgtctggccttgacgacttttaccaggtgtttcaagatgcacccctgggttcgttgggtaatggactgaaaccaaatacaactgagtcaaaaatggatcttcaccgtcttctctcccttccagaccattcccctaaatgatgaggtgacctttgcaatagaggagaagaaggctcctcttcagcaaaatacagctgccactgagccttttacctctatcaagggtggaaatagagcagttcaggattattccccgtagcaagaagatggatggcttcttggcttctgtggttttcaagccatttatcattttggggagggggagtatgaacatcagtcaaacatcacatcagactcagttctaagaactcccacctagcatgacatcaggaagcatgttcgaggggtcgtattatctagaaaggaaccagaggaattgccttccctccccctttttccacaacatgtctctgagtttgtgtagtggagaaaatggtggattcgcaagtatcagagggaaagaagaatttatggaggttttaggaaaacactttcgcactgtgagctaggacttgaaagtaagaaggctgactttttaacaagcgtagaaacacttaaaagccagaattagtgctgccctttagggcagtcaccctggaaggctgcacactgattccaacaatgtggccatagaaagttcttctttggaattgcttttcaaagccttttgaaaagaatttcctccagagtggcaaatctttgtcctttgaccatggatcagagttttaacaagagccaatgtcgtttggagaggagtgaagcaggggactcaggtggagaattgggaccactttttttttttttatggaaagcacagcatggccatgaaataaggagatttatcttctatatgattcataggcttttccagattattttgaaaggatggctaggatttggtaaatgatgcttctagccatgagacagagggaggcctctgtgatgggggacttggggagataaccttcaggggtaactctagtcactgactgattgatttgttctcactcctgtaatattcagacctttgtctctgaactgcttcccctgcctcctcctcctcctctgacctatactattgttaggactggagatcttccttatgtcctgattctctccttacaacctcatctaacaagcatggtgtatagagtgcatgttataataacaaatgatggcatgaaaaatcaccctatgtcagtggcccaggaagctacgggcagaattttggagcagggaggaaaactgagagactcattcctcctgaatatactcctgactagtagcacttctttctttccacatctgacttttacatgtttactacctggaaaatcatgtctcagagtctctcatctgctttttacactccttaaaattttcttcatatcaaactgacatatgttgatagtcaaaaattatcaaatcattctaaaaagcttatttcaacaacagcagtctctggccacattcttctccaccccccagacccattcacaagaagaagccactttcagcacttctagctgcttctgctatttaaaatagcatgtacatattgagtgcactgcacatgatatcataattgatcatttgcagatactgtctgctaacttcctgttatagtgactgaaaatttagcttaatattgatttacattgctatttattcttttggaatgctcttaggatcttctctttattcctagtattctggaagttcatgatgagagagagagagagagtgtgtatgtgtgtgtgtgtgtgtgtgtgtatgtgtagctatatatagattcattgtgcttaacaccctataggcttttctagtttggagtcactgtcctttggttctgagaaactttctattaattatttaataatttcttctctattatgagaactcctattgctaagattttaaggccaggtgtggtggctcacacctgtaatcccagcactttgggaggccgaggcaggagacttgagctcaggagttctcggccagcctggcaacatagtgagaccctgtctctacaaaaaataaaaataaaaaattagccaggcatggtggtacgcacctgtagtcgcagttacccagtaggctgaagctggaggatcacttgagcctgggagatcgaggctacagtaagctataattgcaccactgcactccagcctgggcaacagagcaagaccctgtatgaaaaataaataaataaataataaatagaaagattttagagctctcgaatttggatattttctctcccagattttgttttttattaggatgcatttactaagggatttccttaagtttatattccagcccttctactgcatcttttactatcatattaaaaattttaattccaagagcacgtttttcatccagatattcctttcttgtagtcttctgttcttttttcaggaatgtaatacatcctcatatctcacatctttccctgtgttccctgaattgcctttggttccttttgttttttgtttttttttgtgttgctgttttggcttctgtctttaatgttggatgctttggtcaggggaaggggtttgttgattagtggatttcactacccagtcaactcctgagccttcattttattagagaatccccagaagctggaatctggagatttctctggaaccattcagagtgtggagagaagaatcctatcttctcctgcaaagataggagggaggttgtgatggggaaagggagagtttacgcatggccactggtattctaggaatagaaaaggggaaggaaggcacctgaccgcccctcacctctgcactccattttgcctcctctccccaaactggagcttctttcattgaatttctctggagaacaagcctctggtctctacagggaggagcacagtacggaggaagatacttggctgttcagttgctcttgctttcttttttttttttttcttttgagacggagtctcgctctgtcgcccaggccggagtgtagtggcgcaatctcggctcactgcaagctccgcctcccgggttcacgccattctcctgcctcagcctcctgagtagctgggactacaggtgcccaccaacacgcccagctaattttttgtatttttagtagagacggggtttcactgtgttagccaggatggtctcgatctcctgacctcgtgatccgcccacctcggcctcccaaaatgctgggattacaggcgtgagccaccacgcccggacaccgctttctaaaggctttcaaacaatccgtgttttcagtgccacaccatattcctgcctttattggcacctggagtctgcagtcacttagtctcccaggaattttgtgggccaaatcgactggactctgagtgccctctccccactgacagggacatttagggttcagcttctcttcctcagctctgccaagttagttaccaatcctctgtttacttttcatcttgaaaagagtttgacgtctcttctctaccgtggtcttttttccaattctctttgtcattgtgggttataacctatttttattgttttttggtcattttggtaggattttggggaaaagggagagaaatacttgtgattgattcatcgtgatttactgcaaccctatctacttcccaagagcaaagaattcttccaagaaacatgagctagttttattccttttaattgaaatatcctttgttcttttctcccttgtgcctcttggggggattcccacacacactgagatcctctaagacagaactgaaaaggaaaacttggagtattttaccacattaccacaactcttcctttaggcctggctctgggattttggaaagatgaactcgttcaagcattttttctcaaaaaacttttagacattatttctgagctatgtatacttttattcagtggaccttcctgaatatcatttgattcctaaatattcttcttaaatgtccccctaaatggataaatggttcaatgttttgagtctgacatatgaactgggcaggaaggaagactgggtgttatgaggtaacaagtaaatatcagagttagtggtaacaacatttaatgataggacttcgtgtggtgacttccagaaattttccagtaagttccagagccatcatctagggcaaatgcaaattcaggcatagggactcagataagaggaacttcaggaggactttctaaggaagcaacatttgaaatgggactttccagacaaagggaccagaagtgcaaatgccttgcatttctgccagcaatcttggcatgatcaaggaaccagaagaaggttagtatacctgaaacattgtaaacagagagagttttcaagtgaggagatgtaatcagagaggccatcagcagccagattaagttgggtcttataaaccctgataaggagtttagcttgtgttctaagtggattgggaagccactggaggattgcaggcaagaaagtgattgatctgatctgtgttttagaaagagcactgtggtggaggatggtctgctgctaggtaagagtagaagtagcaagaccaagacaggaagttattgctataatccagatgagagacaatagtggcttggaattagggagtggtaaaagagatggagagaaatagatagacttgttatatgctacagtggtagaacccacaggactgcttagtggattgtatatgaggagtgaagtctgatgtgatcctagatttatttggtagtctttgactggttcccagattaccaggatactatacttctgaaacccctaggattgagtaagtgcctcttataattgatgtaatgggaatttactgacaaattctgtactttaagaacagatagagaaacttattttattgatgatctcctcaagtctcccaattttttggctttaaataccttccatatggctaatgactcccacatttatatcttcaaatggactacttccttgagcttcagactcatagccccacttgctcactttccatccaaatgtggcatatctaaaactgagctcatgatctttccaaccagcagcccctacagtctttctcatctcagttagggcagctccattgctccagttattcaagcaaaggcattggagtcatcctgaatactctctttttccctctctctcttacataatatatatagtcttttaggaatcctacattcaaaatatattcagaattggccactcctcactgccttccagtgccaccaccctcatctaaactgccgttatctctcatctggatccctgcaagggacttctaactgtccttgccacttctgccttgccctctgtgttctactctgaatgtatcagtcagagtgatcttttaaaaatatcataagtcccttcttagtctgttcagattgctataacaataccgtaaactaggtggcttataaacaacagaaattcattgctcagagttctcatggctgggatgtccaagaccaagatgacaacagatttgggtctgctgagggcccacttcctggctcacagatgatgccttctctctgaatccttacaggattacatggcagaaggggcaagagtgctctctggggtctctttaattaatataagggcactaatgtcatcatgagggcagagccctcactatctaatcacctttcctaaagccccaactcctaatatcatcacattgatgaggcctcaatatatgaattttgaggggacacaaacattcagaacattgaaggtctcataacctttctgtataatatgccctagtgactcttagttttcctcagcataaaagccaaaggtcctacatgatctcattctttgaccttagctcctactcaggatattaggaaatactttctttcaaggctctgtgctaaaaaaaagtttattatgagacatctttaattgagttttcattcttcccccaaaacatacacaaataaaagaaataatggtcctacattttggctataaatatttccataaacagagtatgtcctttaaaggagttgaaatgactagtgagccataatttaaagggtggtaaacagtgggtagggggcagcatattggaattgtatcttagaatccttggccaaagaaaatgtacacaaaagaattacagaattcccctttcccctcttctggtcactttgtttattccattttgtctagattgatgaggctatgtgacttcagcttgtaacatttaatttattgctgctaatttttattagtttataaatataagctattaattttttagtactttgagaagaaaagagaaaaatctttggactgattaggagtatattttaagggcaggatcctggaatagggtgcctggaacaatgtctagtgaccactttgtattttccttcaaaaactggtgttacatgataattagccttaaaaactggcagaatgtgatcaaatttaggataggtggcattgaggcattacactaagtaattttgtgtttaggtcattgtagcaattgtgttgaaattactgtatcttcatggccaaatctctattatggttaaggaagaattttatctaatatccataattaggaaatagtggtcaaagagattcattattttgacctatatttttctggtacagaataatcatttgttaatttttgttcaaaatgaaaatgagctgaagtttttctgattataaacttaaaacaattcagatgatacacaaaagtctaaagaaaaatcaaaaatcagaatctctcttcccagagatatctattcttaatatgtaagtctattgctaccatattttttctgttttttaatatataaacctaaagtgggattgtaactctacatactgttttacagcctcctttctacttaaccgtgtatcaagaacatatttatacgatagcaaatttggatctaaataaccccttttaatggctacataataaatgataaagatgccttttattttttcaaaacatatactggtagaaaaatgaatctagcttgccttaaagatttaaaaggtatgcaattgaagaaatataaggacattctattttgctgacatgtaatatcaaccattaaactaaaaggacctttaaatctttttaacaaaatttcactatagtcttcattactgaatgagcaaatttgcgtctgtggcaactacaacaagtatttattgaacacctactaagtgccagcactgatcttgttggggatattttgatgaattagataggcaagatccccgctcaaagaatttacattctggagggtcagaagcaataagaaattgtaagaaataagaaaactatcagatattgaagcatatatggtattatgttttcatgataaaattgaaactgacattttggtcttgaattctgcagattgagtcaaattatatattataattatattttcaggtttgaagacagtgaaaaacaaatagattataagtcatttttctctgccctgaactggagaaagaatccagtgcctgaattgcaaccagcatcataccttaaagaggtaaaatgaatacctattttaaaaaccatctatggttacttcccttgcatgtttaatatcctttatctttaaattatttttcattataaaatattaacatcagtgcttttggaaagagtgcttatgtgtttctgggcatttgtgttaaaggttaatttactttccatgctgagcaaacatctgctctgtaaaagcatgacttttcttatgcagctgaattttttttaacctcgatcgcatccaattatatggaaaataggataataggttacagttataaatagatataaacactgttatcaagggattctggtaacatcatcataagccacaagagcaaatctcaaatggtgcctatggcaagaatccctagggtatccgggtatccgcggctgtgcacacaggtttgccatgggtgaaacaatagagaatggggatgcacatttcacagtgaaaccaaatttaaaatcaaaattctgtagaaaaatgcttggttagggaaaacaaagttcacatgatcagatggtgctctcaacattgtggaattgtctgaattctctaagatctctttggactaattgtctttaagaagtgggtgggtgggtggtggtttgtttgtattttaacatgctccagaaattgattttcttgggaaagtcccttgataaagcaaatgtcatgtggttgatactcccagaaaggaggcatttatttctcctggtctctgctgaccagctcattctggctggagctggtctagtgcctctgggagttccctcaggcatgcagctactccaagggcagccatagaacttccagatggttgggggaaagtagtagcctttggagtcagacagagctgggtttgaattttggccctgccacctacttagctgaatgactttgggtcagttaagttacttatcttgttgatttatgaatgtaatccccagataaatcaggattaagtattgactctcatcaggttctctgctgtaggctggggtccagagacaaacattgtcactgctacctttgaggggcccactactgatgggggaattggtacgttcgtgatttggagtgtggcatgatacagcctgcatgggattctatgggatgaggtggtagctgcttctaaacagactgggggggaacaggaagtattttcaggggaggtgacatttgaaatttcaatgatgagtagtaagagttagcaaggtaggaaagtgacatggtctggaaaaggcatttccaacagaattctctggacatgggacagcatggcacttgtacagaaccaggaggaattggtgtggccagagcgaaggcacatggggaagaggtgaaaaggatgaagctggagatacctgtaagggtgacatttgaatattgtcctgcgaggtctggagaccactgactaacttcaaggaagacagcaacatgatcaagagtgccctttacagggaacttgctttggctggatggtgggtagactggagatggagtctcactctgtcgcccaggctggagtgcagtgatatgatctcagctcaccacaacctccacctcccaggttcaagcgattctcctgcctcagcctcccgaatagctgggattacaggtgtgtgccaccacatccagctaatttttgtattgttagtagagacaaggtttcaccatgttggccaggctggtctcgaactcccggcctcaagtgatctgcctgccttgacctcccaaagtgctgggattacagacacgagccaccacgcctggccatggaggctcttgtcctgttgtccccatacataacagcaaacaaagcatttactgtgtgccaactactgttctaagatctcaaaatcacctagcttatttaatcctcttagcaatcataggtgcatttattattcccagtttagagatgaggaagttagggaaacagcaatgtaaggcagagtcagaattttaactcaggtctcttgctgcaaagaatacaaaagaaaactgtcctttaaatataattatttttgaagacaatggattggattaacccaaatctgaaacactatcacaaaaacaaatcaatactgtcatttgccctgataaccctttcattctcatccatgtgaatatttaatttttacatacaaatagaaacatggtagatgggatttacattcttctacctttttgttgaatgttctagtagtctatattgactgtgtccctgtgtccctttagcactgctctccagagccctctaccgtgctctgaccctgcccaggccagtccttggcagctgacctttgtaggcacatcagtgggtcccctaggcctccagttgggttgaccagtgggatgcaccagcaggagagtagagggtgaaaggagagagaaatcttcttcctccctgccagtcacagcagattgacggcctcctccttccaaagtccacagcacttgtctagaggctctttgcatatggctggtcactccaggcgctggtaaccaccctcatgtgccccttcagcctcaggtggtagtaatggctccctgctgttataaacccaggggactagcccctattggtttttctaaacacttcccacaactttgtaactagtcactttattaaactcttctcgatttccacagtttgtatatgtctgccatttcccatgagcccctgaataatatacaggacatacctatttttgctataagcctttgtcattgttttccttactttctacttctctctttcctcttccattccactcaatccaccacccaaatgtttacctctgtgttgggggttttatcatttcctcatgtattgtatgaaaataagatcataccacatgcatttatctggagtgtgctcttctttcttaatcgtggaaaatttccctagtttaatatgtatagacctaagccattcttaatagctgtggtatgaatatataataatttattaatctcttttttttttttgagacgaagtctcactctgttgcccaagctggtgtgcagtggtgtgatctcggctcactgcaaactccatctcccaggttcaagtgattctcctgcctcagcttcctgagtagctgggactataggcacacgccaccatgcctgactaatttttttgtatttttaatagagacaggttttcaccatgttggccacgctggtcttgaactcctgactttgtgatccgcctgcctcggcctcccaaagtgctgggagtacgggcatgagccaccgtgcctggccctattaatctgctctttattgacaggcattcaggttgtttttacatattttgcctctgaaaacatattttactactttaatttttattttcctgatgactattgagtttgaatgagatcctgtcatctttttgtactacaacctacagtaagaaagattttttttcataacaacacagtatgcagatatataatggaacaaaaatttcacggattaatattgttctgactacatgtggtgcagtatgatacattttcttttttcatttctctcttcctttcttttcttttcctttttctcattccccaccacctctttttctcctctcttttgaatgttgttcgtgacccattaaattgatttcatgacccacaaaaagatcaccatccacactagaagagaagtcactgcatgggaaggccaaagatccactctgcctttaatcacccctccccagtttcatcacttcaactctgtcaactgggacaggtatcgagctgtggacctcagatgcttttgagaggcaatgtggaacagaaggtctccaatcacagggaccctagttcaaatccttagctctacgatcaactaactgggtgactttttacaaagcactcaacctttcaggttttcccatctcaaaaatggtgataagaatagttcttccattagggttgtgaggattaaggaagtcaatatacacaagtcacttaccacaatacctctcccatagtaagggcttaagtgttagatgctattattttctgtaaaattgagatgtcttactttcctcaagtcagggggctgggcagtccctgccaaggttaagatgggagattctattctttaatggcaagagaatggttctaggccaggaatgtcacatcagaaacagctgtgcttcagcactaggttcttctaattgcgattcatttacggtgagaaatttactcatagggcctcatcatttctgctgataaagcctagaaatatttcagtctgcaggaggcattcagaaaggactattctttttcagccaattaaaaagaaaagaaaatagatataaaatggtacctgatcaatttcaccaataatgagaatttaactagattccaaagagttcgaagcactctggtactgataagcttgttattatttcataaagaagacataaaataccttgggaatgttaccagtgagtctgtaatctcatgtgaaaatatttagcatgaaggggttgagcacaatgttgaatagtttatacagtagaatacaggagcaaaaagtataatatctactgacccatgtaagtgtgctcaaatgttattaataatgttgaataatgccctgaaacactgctgggtcagagtttgtcacaggtggggttctccaggaagcagatggagtctaatgtgcaggatgtttttttgggagtgtccttgggatcaactcccatggaaggtgggggaaaaaaagaagaatgggcagagggagaagtcgaactgtgatggaagcccaaagatatccttggccaacccatagggagctctggagttagcatgtcttttcagcgttgtcctgagttgggccagaatggcctggcctttgtcctggtgggttggttcaagaagagatatgactttgtgcagcgtggctctttgtagccaagacatgtttgtagctcaggaaatccaggaaggggactcccagcagctgggccaccaaatccctcctcaaggggattctgggtagtatatcacagcttggcaaccaactactcttgaagcccctgttgactgttcttggtatcaactgagagcctagcagtgtgacagcctcctccccagcttgttccttggttatttcctgatcttctattcatggtagggaactgagaggagagtggttatgccataagaggccatggtggagtcagaccagatgtgtaggtcccgggggtgcaactgggcagagaaaacctcccagttatgactttggggattgccaacgtttggggagtcttccatagccagccagtcacatgtagggcttcagggtaagatccatcaggttgtgaaggcaccccagccctgagtgtgaagtgatgagaccagaggtcttttgagaagaaggaatggcaggctgagctcccgtgtggaagcaaagcttagatggaggccccagggttgggaagctgcacccttcctccagtatatgagccggacaggctggcttgggttaaagtttcagaggtgttatgaagagctctgtagaagttaccaggacaggccaccacctggaacgtggatatttttactcctgggctgcatattgtcatcagcaggatctcatttctgcactgggaatcttccttagaaataaaaaaaacttattggctgatgaaagctgagtaggcttcagtactagattcaactctaattctgtctgcatcagcgtgaatggataggatggatgttatgggtggaaatttgggacaccttcccagtctagtgtgactaaccatcatggggtgagaagggagaggtcagaaaccaggaacaagaccacaggcttcagccaaccacaggctgagtaggggtgtggtctggtccacaagacttgagattggaagggagttctagcagggcatccctccaaaacagtgagcatagtgatggggaatcttgaagttagcaccattcggcaatcagagggagccactcagcaggctcagaccaagctttcaccctgccaaggggacagagctggctaagcccctatacccgtgaggttatagctggaaatacacagcatactcaaagggatcctggagatggatttgataaagggactgttgacggggtgggtagggttaagggaaccaagcggggcggggaggggggtggagcactcagggactggcaataacgggagaagcagggagggactgggggactggtgttattggagcccagcagaggagctggaactatagcagcaggtagagtagtgtagccactatagccactcccaaaccatggcctggcagggagggaacaggatgaagggaagtgaaatccatactctgacctcttgcttctcctgttttctgatctcctgatgctgcttcacattggctgaacccacccagaagccagagagcaaggaagcttgaggagtgatgcaatccacagagtcagtctcccagggcagaaagcagagtgaaaagggcaaagaatggatcttgaggggcaaatggagactgacccagcacaatctatttgttaccagaataaagccttgagctcagaacaagccccacagccaggataaaagctaggtctacactaactgcttctggggcttggtctgctggatttgaggaccagtttcctggactcagaggtggctcccctacatgtgctagttaggtggcctcagctagtaagaataggggtcaacaacaaacaaggagaatttaaagagtactatagtatagctagtctagctttgattagtcctactgtcctttggtgacaggtttttcctacatggttggatgtaagccatcatccatcatgactgtcggctatggcctgtagccaatggcctgtagcctggattctcattggactcccttggttatccctctgcctggcccatcagcagcccatggtgagccatggggctgtaatttaactctcactccattatgtgactatctatggtctcagcatgttgccctggcactgtcatggcctggagaccccatttccattctattgtgtttgctcacagatggtagctgtaaaactggcagaataggtcccactgtttagagcctgtctggttaatctcagaagtcacgttttaaaaaataacactaaatcggttctcatataaactttataacttacactgtgtgactggcgtcttatcttttgacatttctgagaaaaattggatgtggcttcattttatgaacatcgtaactgcagaagcattagcagtcagctctaaagcactctctttcacaataggatgatatacggccttggcatcaggaagtagggggcagttgggtacaccttgggaaacatctttggacacccgccttgttgagactctccttttggtatttagagcatggaataacctgtgacattttgttgtcccaacaatcttgcaagaataagtattatccccaatttatagacaggaagctgaggctcggagatattcctaatggtaaggattgtatagtcaggggctggtgccaattttttaaataagtaaagttatttctaatatttgtggttgaatataacagtcgaaataaaaggttgttaaccattcctcttagacttaaaaaataactggcaaacacatactggtgacctaacacagagcaataacctagtaggaaatgatactcctggaatccactttcatctatagcatcgggttatgtccacttgaattgtacacataagcctatcactgaagctcaaaaatccacatctccctgaaaactttacttgccctgcattgcacttccaaggaaaggttttgtttagaaactacgcctgtcttttagctacaactcacacatagatgacaactctgttgaagctttgtctagggaaaggggagacaatcatgaaatattggcattgctgtaaagtcagaaatgtatagaaatataagctaatcttctggttttatatatgagcttttccttatgttatcagaacgctcttgattatctcaagaaatattcgcaaaatcctcttccccaaatttatttcaatttgatttgcttaaaatttaattgcttttatgattttgtcaaactaattagattatttccaaagccatgttaactttatttgaagggagaaaatctgagaaaaacacaattttaatactatacacaccactggccttttccataaatgtatagatatttctcatagaaacatccttttcctagtgaatagaggggagtaacatggtgaaatcaccaacatgactctatctgccttgcatttgggaggaataaaaataaccttatttcagtgaagcatggaatttaattggctcccgatcttttcccctcatgcatctggtggccagtattacagcagaaaattttaaactagaaggagacataatccaattaaatttccttttaaaaatgtcaaagcaaataaatctagggcccattagctcacacacagctttgctgttctcactgggcagctgctgtttactgggttttcatccagtgccatctttgcttcccatttcaagggtgtgcgattttacagatcggcagctacattttttcaccactgatgaacgagtaatttattgccaactggtttgacatcttaagtgcctcgagtgacagccagcttggaagatgtcatagggccttcttggagacaatgattcccagacattttagaatcatgatttttgtatcattgaatttcactctgcatttcatagttcttccttcttccagaaaacactatgtggcatgtattgtttatgctccagattacatcaagttttcttctgagatttgggtgctgtcttttgagttatctggaagtgacttggagactctggatccatccagtttgccaggaagttgctttgtttcaagctgtgctgtggctttcttaaacatattcttaattttgataaatgcaaaattgcatagaatctacatctgacttcctctagaagcagacttggagacaaagatttaagtgtaaatcatttttgggggaggagtgaaaacactagtaaggaagtgggagagtgagaaaggaaagggaaggagctactaaaggcatattagcaaaccagttacaaatgtagatgatgtagacgattaagagttttgttttgttttgttttgttttgggacagggtctcactctgtcacccagggtggagtgtagtggtgcgatcatggctcactgcagccttgaaaccctgggctcaagcaatcctcctacctcagcctcccaagcagctgggactacaggcccacaccaccacaccccgctacttttttttttttcttttgtagagacagggtctcactatgttgaccaggctggttcagaagtcctggctttaagtgatttcctacctcagccaccccaaatggtggaattgcaggtgtgagtccccacacctgacctaatgattagagcttaatgcaactgggaaacactgacacttcagagtcatcccacccaaagtgcaagggagctgcggtattcatccatcaactcccatcagtcactgtttgagggctgctcttgaagtggaggaaaggaaacaattccctggcacttgtggcttgccacagggacagccaaagcaagcctcagaggccaaagagaagcccaagggcaaaggaacccaggtgctggcagttggaagtcagattggtgtgctccagagtggaaagaatgaggggataggaaggggtgctggcagagcctgctgcacgtagacagttaagatcccaaattccaaacctgcactgccaggagaatctgttttacagagacacaagtaagcttgttctcacctggaatgggtgggatcaacttctgtggatgactcctcctgttgtaaaagtaccacgcagttattcccacttaaaattgatatgcattgctgggaaagccatatgatatgagtttgctttgcattgcatagtgtaggattaataaaaagtcaatgaagacagtattttaactcactgcccagattttcataaagattctataatatttggaacatttgcagatttattaggaagtacaattaggcagtggtaatatgtggatttcttatgttgccaaaaatgtcttcattttaccaaggggctggccatgagattccttaagtaaatccgattatagacaaaattatgaagaaagtgcctttccctctacttaattgatgcccctcaccccatcccctgagccttggaaacctcccctgtttcctaaccttcctttggtcccaaatttgattccattagtcaattgtaagccaataggtgtgataatctccctgaaattgggggttggcaatagatggacccacagcactgttaatgtgcttgtggcatttatgaagtatttggacagaaagtcattcccatctggaacctaaggaagagtgacaaaaggaaaaataatcaagggaagtggtattgattcgaaagaaagagcacaatggggccggcatagttaggagagctttgtgagagccatggggtttaaagtggtcaggatttaaagaaatggactgctgttatcttttcatcttaaattatccttaattccaaatctcatgaatatttacttgagtttccttgtgcccaagttgctaacaaatttgatctcatctccagattcttgagttgtcaagattgcattttaagttctattattttctctgtattgtcagcatttaaatcacaattccttgctcaaaaaatacaaaaacaaaaccacttttgctgactcataagccatgaggcagaatcttctagtcctgacctgtttcataagaggatccagtccccgaataatttcatcatatttatatgagttacataatgcattatttctgtgttgaaaacttttatttggaagacctattagaggatggtgatttttgaaggcatatatttgtactgtttctctataatgagattaaatttacaaacatcacttaagagcaaatattgctgtaagttttgtaatgaaatttttgaggacatgttaaatagtggagttgaatgactattgatcttagccttcattgattaaaatatattgttttgtgtgtgtgtgtgtgtgtgtgtgtgtgtgtaatggtttactactttttggtgtaagtagtaagtagtaaagtagcaactttgttttaccaagttccatgtggtatgagttgcacaaaacaccccttaggagtgggtttagccatcagccgtctgaatggtgatttccctcttcatactgccagttggtggtttgggctcaacttctgagaggcagcatccttgagagagaagagtagtgtcgcttcaagaactgccttgttttctacttaacttttcttgttggaagtgtgaggaccaaatgtagctatgtaggacgaaagccagctgcttctgaatagatccttgtcagctctggagggtagccccgcagacgagcatagttccgcagctccactgcccaggttattataatccaggcttctccactgactggaggtttgacttgagacaatctatttaatccttctgtgtctcagtttctttttctgtaaatagattatcatcataatacttatctcgtaaggggtttctgtgatgattaaataacttaatacatgtaaaacacttaaaagagtatcagccatgtagtaaatatccaataaatttattgttattcctattactactaggtaattacaagattcctatctataaccctgcacaaatctgcaactagtttatcatcatcataaatcatctctgaaattaaggttttacacctgaattagagatgctggtacttagttctcttctgattctatgacaatgttatatttcatatatgactcatatttcagtgacttctatatctttgcacagttctggattctagctctgtgctatatagaaccgtatttacagatgtttaccagaatcttcaccttgatgtcccatggacacctgaaagaaaaaatgcccacagttgaacttagaatttccctctgagccttgttttcctactaaaaaatgtttttcaacttttcctgctttccttatgatataacaccggattgaatattgtcccctccaaaactcatgtctaccctaaacctcagaatgtgaccttatttggaaataatctttgcagatataattaattaaaatgaagttatgctggattagagtggaccctaaatgcattgattggtgactttataagaaagctgcgtgaagacatattggtatacacagagaacaccatgtgaagttggaggcagacgttggagtgatgtgcttacaagccaaggaatgactgccagccaccaccagaagccaggagagaggcatggaataaattcttccttagagcctccagaaagatccaacgctgccaacaccttggttttggacttctggccttctgaactgtgaaagaataagtttctgttgctttaagccacttactttgtggtactttgttacggcagccccaggaaactaataacagacactgtcaactattactgaatttagaattcttagaaccatccttacctgtattagtttcctagtgatgccctcacaaagtaccacagactgagttgcttaaaacaatagaaatttattcttccacagttctggaggctagcagttcaaaatctaggtgtcagcagggccatactttctctgaaacctgtgtgggaatccttccctgcctcttcctagactttgatggttttctggcaatctttggcgttccttggtttgcagctgcaaacctctaatctctgcctctatggtcacctggtgttccccctgtgtgtctctgtctttacctggctgtctttttatagggaggccagtcatattggattaggggcccaccctactccggtatgatctcattttgctcatcttaatttacctaattacatctgcaaaaaccctatttccaaacaaggtcacattctgaggtactagggattaggacttcacataactcttttgcatgaggacacaactcaacccatagcactacacctttcttttgtcaccatttcaagttgatccccttctagctatttcatgttctcctgcagcagcatctctcagagtagctcctgtcctccatgcccgcttcagccaccctggttatggcacagtcatttttctgcggtattatagtactcacctccagattgattttcttacttcatgtcattctctgtacatccagcaagttagctaatcagtttctaatcagatttctgtcatttccctggccaagacctaccagtgacttcccctaaccacagcctcaagtataaactagcacagaaggccagaagtttggccccagcttctccttctaaccatctctcttgccactttgcaccatgtgccgcaaaccacactgggctactcaccctttcttgaaaatagattttagatctccaggcctttgcttacgctggtccctatgcctggaatacccttcacaaccctaaaccctctgctgaactgtttttcatcccataaggtgcaactgaatcaccacttattcagcttgcttccaaaattccatcacatcaaattattgagcctttacctatgtttctgtgacaccttgtgattctggatactaatgtaacactagtaaagatatagaacctcttatatacaacaattaaccttgacagtcatattttaaccttgaaagtagaaatataagcaaccatatgtatgaactttgcctcctgttgatattaattaaccattgaggcatatgcaaaaagtttgtgtgtgtgtatatacacgtatttatgtattatataaaatgtgcatctgtgtgtgtatatgtgtacacacacacacacaaataaagtggcttatctgcaagatcatactgtgagtgatccagtgttcttttcattgtttactgaagaaacagtaaccaatcagccagtatagataccagtttgtattttaaaaattgggttctttaggcagcagttcacgtctgtaattccagcactttgggaggctgaggtggacatataacttgaagccgggagtttgagaccagaccagtccggcctatatggcgaaacccgtctcctagaaatacaaaaattagccgggcatggtggcatgtgcctgtaatcccagctactcgggaggctgaggcatgagaatcacttgaacccgggagttggaggttgcagtgagcagagattgtgccagtgtactccagcctgggcaacaaagtgataccctgtctttaaaaaaaataataaaataaaaataaaaattgggttcttaagaaagtataggaggatctatcagcgtattcatgctgcataacaactccttaaatttcaatggttcacaacaagacacatttctttttcttgtctatgggcatgtaggtcagtgaagcatggctggattcagctaagcttggctcttagtccgcaagtccagcctggtctgatccaccttggtcattctaagaacagcagcatcctgggccatgttcttttcatggtgatggcagaggcacagaaggccaagccaaatgatgccagcacgctagagcctctgtccatgatatgtctgctaatagtacataggtcaaagccagtcatgtggccaaccccatatcaaaggaacaggaaaatatacccttcttactccacaggaggttctacagagtcatatgacaaagagtgtgggcacataattcttatacagggagggaatgaagaatcaagaacaagtatccagtagaccacaaagtccttatgaacctaaagtagatggtagaaattttcactttgcaaataaactggtgttgaattttcaaaactgtactttgaaatgtggttctaatcatatccatttttggtttttttctagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccaca

SEQ ID NO: 3364 - DNA, 3119 bp, human
acagtccacacccagcaaccatcaggacgccccctgctcccggcccgaagactgtagggaccatgggaggagagagtggtggctggaccggtcggggcgtgtgcgcggaaggctggagttgcttgagtattgtctgccggggccggcgcttgcgtcagggtgctccctcgcgctttcgggggtagggaatgggtttgctgaacttactctgagggctgatactgcacatgcccttggcgccttgtgcatgtttggacaagggtttaatggaggcacgtgggagcagtatcgatctctggcgggtccccaaagaccctcttgggatagtccagagcgtgttcggggttgagagcgaaaggagagtgttccgtgtgaatgtgcgtcctagggaggaggaggacagtgtctcaaggagacttgattttcttttatttgctgcaattccgtaaaccaaatcatgctttcgaggcgttaaagtaaattactggtaagtggggcggatctctgctggggataaagaagctcccgggtttgcggggtagcgggcctggctggcgtgcacgctcggtggcttttggcgctgtctcgcctaggtagtgggggtggaggtggtggtgcttgtgtctttggcttaaggtgctggagccgggcttacttgtcctaggtagactgtgggacttggaggaggtaaaaaagcttcgcggcgcggttattcgcaattaactccagaaatctcagtgtgtgtctgtcggtcggtctctctctgtctctgtctctctctctctctctctgtctctgtctctctctctctctctcacacacacacacacacacacacacacacacacacacacactcgcacgtctcatggctgcttggatttgccgatagttgttcatgaatttttattcctgtttgttcatttcctgacttttttttttttttttttggaaaaaggacctacctgtattaaaatccgtggggtttcagaaagacccttccgcagtcattcatattcaaatcaaggatagggcattttgatgaaaataccccaccaaactgctgtttggattggacaaaactgtagttcaggttagaattactgttattttaaatagacatcttacaaccttgtggtaaagtaaccttagcctgaatcgcccctgatctttctttgtgtcaatttacagaattctgaattacagatgaacaaagcggtgaagttttcttttaattttaaacgacaggtcttgaaatggctgtaagttgagttctgcgactccatctctttaatgatcggctcagagtggtgtatagttgatgatctgagacttacatatgtttcaatttctaatcaaataatttatcataccattggggagaaggacgccttaggaattttcaacacagaggagaaagaacatttttgtcttttggagcaaatgttttgccactttttccccagatgtccccgttagatgcctagaaaagatgcattgttgacgaataatacatgatttatttctcttttatgtctacaggtggcagtgtagaagccagaccgggagcttccagaagtggtttctgaaagagtcaaatgtacatgagtaagcaagcacaggaatctgaaaaaccacaggtatgtaggacaattaatccacctatctagctttataattattgcattccagtagtactaacccatttgctcttatgttcaatattttgacacttatataaatttctatgaagtgaaatgtattttgaggtaacctccgaggagaagcagggtctaatctatttctgacaatgtatttaaataaaaattctgcatgtcattatattacatgactttttactgttctaaaagagttgtttttccattgtgaccatgtggctttgcatttaaccagttgtttgatatctgcttttcaaaacacttttcctgaaactacataaaactgccaattgttctgaataatttcatttgagataatgttaacagagtcacctgcatgaaccaataacaatatcagcttaaaaattttttttattttttggctgggcatggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggtggagcttggagtgagccaagatcgcgccactgcactccagcctgggtaacagagcgagacttcgtctcaaaaaaaaaaaaaatttttttttttttttttttttttttttggtgacagggtttggctttgttacccaggtggagggcagtggcaggatctcagctcactacaacctccatctcctacatcctacatctcctacatctccatctcactacaacctcccacaacacgccggggttgtttttgtattttttgtagagacagggttttgccatattgtccaggctggtctttaactcctgggctcaagcgatctgcctgccctggcctcccacagtgttaggactacaggcatgagccactgcacccagccaagtatcagcttttaataaaactgcatctcactgttgaattgacgtaacaccgatcagaatacagatgcattaggaggcttcttttaaaccaagcccttctgctattaaccttctgatgatttttctcctactaccttgctgtttttacaggcccactaatttgcctgcttgactaaaataaggacgagttatgtgctgatgagagacatgtttgtaatgttattcgttgtgacacagttcaaaagaatttgcctttgattctcactaaaatgtaaagttttgcatattaagatcctttttcaacaactgagcaactctttataatgaagggcagaagacgccaaagggaagaaaatatttacctttgtgggcttttactttctttcctgggaatggtaggccatagctattggtatgtttttttttgttgttgttgttgttgttgttgttttttgagaaggagtctctct

SEQ ID NO: 3365 - DNA, 3411 bp, human
gggaaatgaggaccaccgctccggggcgcgagtaggcgcgtggagtccgggggctcagccgccgcgcctcttcctcctgcagctggagactgcaacagcggcgggtgcaccggcagcagcgacgaccctgcgcgcaggtgggcacccccgagcgcggcgctctgccggctcccccggccaccgcgggccggacgcccgctcttccaggccactgcgcttgggggcgagggctgggtaggtccaggggcagaaggaaggtgcacggccccgtggtgggcgcgcttctgcgcgcgcgctgtggtaggtgggaaagaggtgcagaaaagctgcctcccttagggttcactccctcggttccactgtccccaccccaccccttctgaggagctgggcacaccggtggggctttggaaaactgcgatctcctacccgccccgcagtatcggtggcgtgtgcaggttgcccttctcttcacagtccacacccagcaaccatcaggacgccccctgctcccggcccgaagactgtagggaccatgggaggagagagtggtggctggaccggtcggggcgtgtgcgcggaaggctggagttgcttgagtattgtctgccggggccggcgcttgcgtcagggtgctccctcgcgctttcgggggtagggaatgggtttgctgaacttactctgagggctgatactgcacatgcccttggcgccttgtgcatgtttggacaagggtttaatggaggcacgtgggagcagtatcgatctctggcgggtccccaaagaccctcttgggatagtccagagcgtgttcggggttgagagcgaaaggagagtgttccgtgtgaatgtgcgtcctagggaggaggaggacagtgtctcaaggagacttgattttcttttatttgctgcaattccgtaaaccaaatcatgctttcgaggcgttaaagtaaattactggtaagtggggcggatctctgctggggataaagaagctcccgggtttgcggggtagcgggcctggctggcgtgcacgctcggtggcttttggcgctgtctcgcctaggtagtgggggtggaggtggtggtgcttgtgtctttggcttaaggtgctggagccgggcttacttgtcctaggtagactgtgggacttggaggaggtaaaaaagcttcgcggcgcggttattcgcaattaactccagaaatctcagtgtgtgtctgtcggtcggtctctctctgtctctgtctctctctctctctctctgtctctgtctctctctctctctctcacacacacacacacacacacacacacacacacacacacactcgcacgtctcatggctgcttggatttgccgatagttgttcatgaatttttattcctgtttgttcatttcctgacttttttttttttttttttggaaaaaggacctacctgtattaaaatccgtggggtttcagaaagacccttccgcagtcattcatattcaaatcaaggatagggcattttgatgaaaataccccaccaaactgctgtttggattggacaaaactgtagttcaggttagaattactgttattttaaatagacatcttacaaccttgtggtaaagtaaccttagcctgaatcgcccctgatctttctttgtgtcaatttacagaattctgaattacagatgaacaaagcggtgaagttttcttttaattttaaacgacaggtcttgaaatggctgtaagttgagttctgcgactccatctctttaatgatcggctcagagtggtgtatagttgatgatctgagacttacatatgtttcaatttctaatcaaataatttatcataccattggggagaaggacgccttaggaattttcaacacagaggagaaagaacatttttgtcttttggagcaaatgttttgccactttttccccagatgtccccgttagatgcctagaaaagatgcattgttgacgaataatacatgatttatttctcttttatgtctacaggtggcagtgtagaagccagaccgggagcttccagaagtggtttctgaaagagtcaaatgtacatgagtaagcaagcacaggaatctgaaaaaccacaggtatgtaggacaattaatccacctatctagctttataattattgcattccagtagtactaacccatttgctcttatgttcaatattttgacacttatataaatttctatgaagtgaaatgtattttgaggtaacctccgaggagaagcagggtctaatctatttctgacaatgtatttaaataaaaattctgcatgtcattatattacatgactttttactgttctaaaagagttgtttttccattgtgaccatgtggctttgcatttaaccagttgtttgatatctgcttttcaaaacacttttcctgaaactacataaaactgccaattgttctgaataatttcatttgagataatgttaacagagtcacctgcatgaaccaataacaatatcagcttaaaaattttttttattttttggctgggcatggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggtggagcttggagtgagccaagatcgcgccactgcactccagcctgggtaacagagcgagacttcgtctcaaaaaaaaaaaaaatttttttttttttttttttttttttttggtgacagggtttggctttgttacccaggtggagggcagtggcaggatctcagctcactacaacctccatctcctacatcctacatctcctacatctccatctcactacaacctcccacaacacgccggggttgtttttgtattttttgtagagacagggttttgccatattgtccaggctggtctttaactcctgggctcaagcgatctgcctgccctggcctcccacagtgttaggactacaggcatgagccactgcacccagccaagtatcagcttttaataaaactgcatctcactgttgaattgacgtaacaccgatcagaatacagatgcattaggaggcttcttttaaaccaagcccttctgctattaaccttctgatgatttttctcctactaccttgctgtttttacaggcccactaatttgcctgcttgactaaaataaggacgagttatgtgctgatgagagacatgtttgtaatgttattcgttgtgacacagttcaaaagaatttgcctttgattctcactaaaatgtaaagttttgcatatta

SEQ ID NO: 3366 - DNA, 14721 bp, human
gcgcatggatattcaggctgtggtacagctttgatcacaagtatccttttaagtagcatcccctgtgtcggtgaaacattggggatgaaatcttgttgaattgtcggtgaatgacacctgataagtaaggaaagatgcatgcttgggacagggatagcccatcctcttatggaacgtgtgcattgagcattcaaccataggtagtcctggtgagtatctctctggccaagaggaatgtttgcatatccttagagtaaccagcccacagcctggtagactcatgtggctcttaagagctttgtgtccagggaactatgcctttttaggtgattagattaaaattacgcaatgaatcgtgctgtggtcagaaaaggaagtagaacttcagctgttaatccatatggggaggataattcctattggatgaactcggccaagtctgatcttgtatgatctgatactggcataactgggccacatgcagggcaaaccctgttccagtagattcacttggtctcaagtgaaaattaaaaaccaaaatgttaaaccctcatggttttttttgtttgttttgtttgtttgtttgttttttgtttttgagatgaggtctcactccattgcccaggctggagtgtggtggcgcactcagctcactgcaaccttcccctcccaggctcaagcaatctcccacctcagcctcccaagtagctgggaccacaggtgcatgccaccgcacccagctaattttttgtatttttggtagagatagggtttcgccatattgcccaggctggtctcgaactcctgggctcaagcaatctgcccacctcagcctcccaaggtgctgggattacaggcatgagccacttcacccaacccctcatggtttcttaagttgacatagtcatcaaatgggcaggtggcttattatatatggtctttggagacgccaaaactgttaaaaatttattgaagtatagtagatatacagaaaagtacacaaataataagtgctcagtaaattatcagaaaataaacacactcatttaacaccaaacgaatcaagaaacaaaattccaaggctgggcatagtagctcatgcctttagtcccagtactttgggaggccaaggcaggtggatcacttgagcccaggaattatagaccagcctgggcaacatgatgaaaccctgtctctacaaaaaatacaaaaattagtcaggtatggtggcacacacctgtagtccagctacttgggccctgtctccaaaaaaaaaaaaagaaagaaagaaaattgccaaacccctcatgccatgactcaattactaccccttccccctccccaaatgtaattgctctgttgacttctagcaacacttaatagttttacctgtttttcaactttctgtaaataggattatacagtatatatattttagtgtctggcttatttggcttgacattatgtgtataatacagccatgttgttatgtgtagttctagttcatttgttctccttgttccatagtatttcttatataaatatatcacaatttattctattattgatgtacatgtcttttgatgtacatatacatattttttttggtaatctacccaggagtaacattgctgggtaataggacatgggtaggttcaactttagaagatagtgccagttttccaaaatagtggtactactttacacagtcacttctagcatatgagagttccagttactccacatcctaccaacatttggtgttgtcagtctttttaattttagccattctattgggtttgtagtggtatttaatcatggctttaatttgcatttctcagatgactgatagggttgagcacctttgcatatatttactggccatttggtatgtttctttgtgaagtgcctgttcaagtcttttgcccatttttctattgagttgtctgcctttttcttactgatttgtaagagttctttgtgcattctggatatgagtcttttgctgatcatacatgataaaaatatctgctaccactttgtaacttgccttttcactttttttttttttttgagacagagtctcactctgtcacccaggctggagtgcagtggtgtgatctcaactcactgcagcctcttcctcccgggttcaagtgattctcatgccttagcctcccgagtagctgggattacaggcacacaccactacacctggctaatttttgtatttttagtagataggaggttttaccatgttgcccaggctggtctggaactcctggcctcaagttatccacctgccttggcctcccaaagtgctgggattacaggcgtgagccaccatacccagcctcactttttaaatagaatattttgatgaacaaaaggtcttaatccaatgtattgatctcctagttagtattttttatgtcctgtttcagaaatctttgcctaccccaaagtcatgaagccaatttcctatgttatcttctagaagctttattgttggtcttctgtgcatctctttttttttactgagtgacaagcatgggcaattttttctctagaaaaaaaatctagagataatttgagatgctctgcctaacatcatcatccttcagagatgatttaagcttatatctgatcagtggctaggctaggggtattagcaattgcagatcactttaatccaaacaggaataaggatgatttgatgctgggccctagttcctgtgagagttagtcttgactgttttctctttaccctttattctaggatccccacctaaagcctggtttccatcttcttcctcagtaggccctggactttcttttttgtcaggttcactctatctttgtgactctgccaaatgctctgctctgtttcttaggtgcctttagggaaactgtggctcaccaaccacagggctcacctctttggtttcctcctctcaaattccacccctcttcactgccttggtagctttctgaagccttcaagcagatggttttgtcttattttattttgtctagcttttctagttgttctcagtggaaaggttggttcaaattaccttgtttgctactaactgaagtagaacccccagggatttttcaagccatgtggactattagaatccagaatgcatattgcctgctggtctcagaaaggatgtaaagaaaatggaagagtatccaccaggagagtgacacagtgctaaagtgagaaactgatcctctgaagaggaacaggagttatctctaaagtttcatctgaatctaaattttagtgactttgggatttccactttttagtttggaaaaaaactaaaaaggagagaaaactgtaatgtaagacaaaggtaagtcttgagccaatttgtccagatgattttattaaagaatgttaagaacagctgcaacaggtacttcctgtgtcaacagatcaattggtagctgctaattttttcttcaagccacagatacctaaagaaagttagagacactacctggagagggcttggtagagaaacagatcttgagggcatcaaagatttttctcttgagagtcactccccacccaactttggccatggtaggagtctgtacctgcctgatgaagagaaaaactaaatagagacatgagggactaattaaacaattatgtactttttgattaatccttagagagttgaaaggctttttcagtcatgatactagagaagattattagaaaaaggagtaaatcaaacaaaaaattcttgaaaattaaaaacaaggtttctgaaattaaccaaaaaaatgtaatggatagctaataacttgaatatgatgaagaccaaattgttgatctggaagatagagttgagaaaaaaaaagtccaataattatagcaaaaagaaacatgtaagaggagagtttcaagatatggaggtcagaatcagttggtccaaatcatttgacaggatctgaaaggagaggacagagactttggaggaaaagtaccaaagaaataatggaagaaaaattcccttagctaagaaagacagttgtttccagagtgcaagggcccaccaagtgtgagtaggttgaatggacacgttcgggggcattccataactacaagagaaaaagagggaatctttgaggtttccaaagataaaaacaagcaacctccaaaaagcaagaatcagacttctcatcgacaaaattggttgttagaatacagttgagcaatgtcttcaaagttctaggatgaaaaaaagaagtctgaacctagaattctacacccaaactgtcaatcaaaaataagagaatgaaggagggtagctttcagacatgtaaaaattcagaaagtttagcaccatgcagaccctgtaagaaggaagaaaaataacataaagatcaaacaaaacaaaatccagcaaaggggacagtgattgttataactcagaagaagtgaacaaagtcaaaaagaaaagatcttttatttggcaagatactcaagggttctcttctgactgacaaaatttaaatgacagtgtgttacatttccttttatattgctccaaccactttgcttggttctccagagaacagcattcatgcaatgatgttatattacaaatgctgcttactggtttttgtttttttgtttttgttttgtttttttttgggggggtgggttttttttttttttgagacagggtctcactctgcactgatcatgcagtggcacgatcataactcactgcagccttgacctccctaggctcaagtgatcctcccaccttagcctcccaagtagctagcatgtgtcaccacaccctgctaatttttgcttttttttttttttttaagagatgaggtttcaccatgttgcccaggctggtcttgaatttctgggctcaagccatctgcctgccttagcctcgcaaagtgctgggattacatgcctgagccactgcatccagtctgcttactggtttttaacacttagactcaatctatacacaaagcataaaaaatctacttattagttataaagtagaaagcaaatgttatatatctccagtataaagttaattataataaaaattgggaagaaaaaattggaaaaaagagacaggagtgtaaatgagttaaacgtaccatccttactaggaaggaaaagcctcagactaaagtttataaatcaagaaatgggggagaagtgtattatctaaagttgtaatgtaattaccagaacaactagagtgggatagaaagacttgatgttttattttgtcccatccaacaatttgaatatttaaaaacatatatatagcttactggttatatatatatatatatatgtatatgtatatacacatatttcttttctttttttgaagaagttgtcatggggccttctggagaggaggaagggggagcttgtctttggagtacctgaggtggagaactgaaaagcagtctctgagttcccctggcctcctgcgtatttgtcattctacagatctgagcctctgtcatcttctgagccaaagacacaagaaaactgacaggcctgtagggtctcttcccaaattggaggagcgcctggtctgcatctctccctgggaatgtggttcaaggacagcaaaggggagctggttccgcgtataaagagctccaggccgggcgcgttggctcacgcctgtaatcccagcattttgggaggccgaggcgagtggatcacgaagtcaagagatcgagaccatcctgaccaacatggtgaaaccctgtctctactaaaaatacaaaaattagctgggtatggtggcacgcgtctgtagtcccagctacttgggaggctgaggcaggagaattgcttgaatctgggaggcggaggttgcagtgagccaacatctcaccactgcactccagcctggcaacagagcgagactccgtctcaaaaaaacaaaacaaaaaacagagctccagccaggcctgcacatcctctttggttgagtaatttcaaactagaagcatgctccagtgtctcccttccatctcctcctctagagagagctgcttttctcttgtgctgctctaaatgaaaacagaaagtgaggggtgatgctcccagcagtcatcctgttaggtacagatggcggtggcatctcctcaactttctttgaagtctcttggccatccctgtagtggaagtggccatctgagaccccaccttttccacactgcttaggctgtaggtttcagaagtggtcccggctgtatcaaaatgtggctggtgcttcatggagcttcccacatagggctgtgcgtttggtagcgctgatattcaccaagtgacagacaagcaagataagctctctgcttatccgttgaccttcatgttagagcagtggacaagtttgcttcccaggggacatttggcaattttttgaagacattttttattgtcacaacttggagaggggagtaacggtgctactggcatctacagacagtccccaacttaagatgcttcaacttaggatctttcaactttacgatatagtgtgaaattgatctgcattcagtagaaaccatactttgagtacccatacaaccatcctgtttttcattttcagtacagtatgtaataaattacatgagatattcaatactttattataaaacaggctttgtgttagatgatgttgcccaactgtaggctaatgttagtgttctgagcacatttgatgtaacctgggctaagctgtgatgtttggtaggttaggtgtgttaaatgcatttttggcttatgatattttcaacctaatgggcttattgggatgtaactgcatcataagtcgaggggcatctgcagtgtgtagagatcagggatgctgctcaatatcctaccatacacagaatagccccccataacaaagaatgatctggccctaaatgtcaatagtgttgaggttgaaaagccttgtgttagcgtctaggagagaagctgtgggtagagtgaagaatggtcctgtatgggaagttgagagacttacagtccgagtaaccttactgaaatcatttcatgttgccaagtctcaatttctgcctttatagtagccccaggctacctctaaggtcctgtccaacttcagcatttccaccacctgccctctgggtagagtggtttaacaggaatccatgcagagaacaagagcagaggggacacaggggctgcaactccccactccagggacactatctcctgtttccaaggcctggagccagttgtgtgtcagaggctgaaatgctgattgaaaccaaaacttccattcaacatgacaaagggagaagggggatctaatttctaattaatcaaatacacgtttgaactgaaaattgggaattaccaacctgagagttaacagttactatttaaggctgatagggcgtatcttactctttgattcaaactgttgcatgttacaagtatttcgtgtgttgtacgagtaaaatggggaaaagaaggtttttgtgggtggaatgtcgggcaattttttaagcacattttgttgtgtatatgttttctttgcagccatttttccttaattcacattttaaagttacctgaagcccatcctcacacacagtggtcccccactaaccaccacgctccccgcctggtgtggcttactagctcgatgtctgaccagtccccaggtgtacgatgtaagtactgcacatcagggttggagtcctggtcaccatgccagggtagtgtcttacgtaggaagaagaaaccatcatactcatgcctccaaatccacagatttttgcttctctaataagctgattagaaatggccatcttccatatgtttatagatttcgcatagtaacagagaaagcttttaccagggtaatgggattcccccacatcggccgctgtggtgtagtagaagaacactggatttggaatcagagccactggattggaatgcaacccctgacaggccatagatgtgctctgcatctcagttctttctctctctctttttttttttttttttttttttttttttttttttttttttgagacggagtctcactctgtcgcccaggctggagtgcagtggtacaatctcggctcactgcaacctatgcctcccgggttcaagcagttctctgcctcagcctcccaagtagctgggattacaggcgcctgccaccacaccgggctaatttttgtatttttagtagagacagggtttcaccatgttggccaggctggtcttgaactcctgacctcgtgatccacccacctcggcctcccaaagtactgggattacaggcgtgagccaccatgcccggcctgcatctcagttttctaatctataaaatgggcctagtagtacaggctggctgggagcattaaatgatgaaatacatgaagatacactgaaccacaaagcatgcaaggattccttttctaaatagtttatttatgttgatatggttaggtcctttctttccattttcagattatagaaatagactcagcacagtatgaaaagaacatgtacactggtggacgtcttagatttagggctgactcctgcactcctggtgtgggttgcagggtacagggcagagaggtagagagagcaaggtagctacccacgtggaaggagtagaggagaggtcagaggccttccttcatccctcttcggccatcctaatcatcttgtcactaacacagtcattatgccctagaagaaaagaatttctaaaatttgcgtacagctctagagttcacaaaggctaagttcattcgttgggtcataccatgaatcagtgagtactgcagcattacagagaaggaaagtgcatctcagagaggatgtgagttggccccgggcccacagttagtaattagctgggaccctcatgcaggtcttcacattcttagcaaataacctgcagtttacttgattggtgatgagaaggcagaacacaaagcctagatctgaaagagaacggccctaaacaggtaagttctaacgaggggtagcagggttaggaaaggcagtgcacattcatgtggtatagaggggaaagggatgtggacaccatagctaggtgggggcgctggggcggaagagaagggcagccacatcagagcagccgagattggaggatgcagctccttaaatggcacgctcttccttcaagaacagggatgacaactgccaagtcaccatgtgtcctaaacccgctgctgcagagagctctgtgtgtctgtcatccctaggccctcggacctctccttggccccctcagaggaaggtgaccattgaaaagtcctggtaggcagcgacagaactttacactgggaaactcagctgggctactgggtttcacccccttcacagcaggttctgcctggtaaaaatgtagttctgccacagccgttgcttggaaatttcaccaaatgtggcagtagcgttcatgtgtctttctcttaaagatagttgaacttccaacacccacggctcctccccatataaaaatgaaattcctgtgccacctgtgataaactggttttaaatgacaaaaaaatatgtaggatggtgagaacaccatttctgtagaactgctcccagtttgtaaagtgatgtctaatgcttgcggtaagttttaaatgtaatatctatcagcctaaataataatgctagttacctgttaggttagaaggacacaaaccaatagattaaaaacttagttttgtaatttctcatcctgctactagcttacttaagaaaagctgtcttgtgctgaatgctgaatggtttgctcagtttggcccgctgtctaaagtggtagtaggggccctttacatacatcatcggagacaaagggtgctgacggcatttccacttctcccactaatgaagccccaactgtgattacactttctgatcttaagtttcactgggtttatatatataaatttgtcttctaactctagtctcttctaaacactttgtaaaactttccatcttaattgggttttaataaggatcacttttcatgtctatgtaatagtaaaacaacaaatccactattaaaactttataaaaaccttatctaatctgaagcttactaaccagtcccttgctcatagattaggaatatctggactagtttgaactcagcataaactcagtaagcttacaattgcatcaatttcaagtgcttctcccagcagttcaagggaccactccaagtttgcttctgggggtcatgtttcagctgtgactccccacagccaacctaagactgagtgacttgggcttctagtgagaatcaccctcggtcctgctgctgctgctgctttgagccggggtcctgcctagggtctcagccagctccagacatggtggggcctgctgctgagacagtgggagcaaagggtctcttcaaaattatcagtggaggaacccaaaactgacagaggtgaaggggctcactgcaaagtttagtgcctggtgagggtctcagactgggcagttctcgtagattttgacacctgttgcatggttcttacccaccatctaaaaggtgttttctactttgccaagtttatttggagatttctaagatgttcatcagtcattatttccactaacgttaaaccacttaggtgtggtatccagcttcctaacaatgttctttcacttttgaaaatgacttctggttatttaaaatgcacacatccccacacactgttgtttgcaggtgttttcactgcattttcatagcagacttaattgcacagctagttacatgattatatagaccttcagcgtaacaaaacaaacttgtgttgatcctatcatctagaattcaagggagcaggttagttttatcatctgcatgtaacattattagactttgatgtcagaatcactctccatgggttgtttgttttttgagacagtctcgctctcttgcccaggctgcagtgcaatggtatcatcttgacccactgcaacctctgcctcccgggttcaagcgattctcgtgcctcagcctcccgagtagctgggattacagctgcgtgccactatgcctggctaatttttgtattttttgtagagacatggtttcaccatgttgagcaggctggtctcgaattcctgacctcaagtgatccgctcgcctcggcttcccaaagtactgggattacagatgtgagccaccatgcctggcctctccatgggtttttttttgttttcttttgttttgttttgttttttgagacagagtcttgctctgtcacccaggtgggagtgcagtggtgcaatcttggcttgctgcaacctctgcctccccaattcaagcaattctcctgcctcagcctcctgagtagctgggattacaggtgcccaccaccaccacccggctaatttttgtatttttaatagagatggggtttcaccacgttggccaggctggtctcgaacccctgacctcgtgatccaccctccttggcctcccaaagtgctgggattacaggcgtgagccaccgcacccagcctccgtgggttttactatggccttgtttctgaatgacctttccttgagtactatgtctgggcttgggagtttcagaaatgcaatgggttgacatccagtcttgttttctcctgtcagtgaatttaggccctgcttccctctgcaaagagtgaaagcggaccacatcacagttcatgcccagggtttcctctgtggtgctgtggtgggctttccttcatttgcggaattaccctcacctgcagttatcctgtgtttgcctctgtccttccatggctccaaaccttgaagcagtaaaatatgtgccaggaccatttccctgaaaactgggagccaagagccctggcagagagattttgacagagatgaacaaaatcattatgtagcacgtgtatgaatgggagaattgggatgtgccgagacagggaaggtgaactccccaggagttggaaattcggatgggagacataagctaccggctgggtgtggtgactcacgcctgtaatgccagcactttgggaggctgaggtgggaggatcacctgaggtcaggagtttgagactagcctgaccaacgtggtgaaattccatctctactaaaaatacaaaaattagctgggcatgatggtgggcacctgtaatcacagctactcaggaggctgaggcaggagaattgcttgaacctgggaggtggaggttgcagagagccaagattgcaccattgcactccagcctgggtggcaagagtgaaactccatctcaaaaaataaaaagaaaaagaaagaaggctactgtaaagcagattgagtttcgggactttctaaacactggtaaagaggaggaaatttgggagtttaaatcaagttttagaactgtgctctgagcatctgcctgaatataggacttttatctcattgggcatttgcaccctgcttcattccagtgaggatttgaagcagcaagtgagaggagttgcgtgcttgcctgtcaaaaatgctgaagcattagttaagtggagtcacagtgtagactgtgtgtagggaagttgacaacactgagaatgcagaaaacaagtatgtgattgttgccagtgagtgcacagaaataagtctgggagaggaaacgcaacccatgagtcttccctagctggtgcatttacctggcattcacttagcacctactgtgaggtaagcaccattgaggaaggtgccaaggtgtggagaaggaggtcactgccctttggcgtttgtcatctagatggggctgatctcggggaatctgcccatggccttgggcagtgtgactgcgcgggggccctgagggggtcagagaggccagttcggcgccctggaggctctgtctcataagaggatgcaggacttcagatgagctttgaagggtcggtgggaaacaggagagaaaaaatcagtttacccagcgtatttgacactgtgtttgcccttctagaaggcagtgcacagtactcaataggcctcagtgcagcgcgggagctgggttgtggccctccccttgttttgttggttaaatctattggaggaagaaggtcctgtctgacctcgtgccgtctccgacactctcgctaccatctgatagttcaagtggttgcaactttgctctccctcgatcatttgattcatccacctgaggatgtggcgggtgggcttcctatcagggttttcctgtggggagatgacaggggaaacagggaggaaatcctgattatggcttgtcctcttccctgaattgctgtctatgacaaagagtagttccaatgtaaacaagacgggttggagacggtttgtatagggcaggagacccacccggaatgcctacccagagaagacagtacctgaaacctatttgcaacgtttgcccaattaccctactctggccttgctttgtgtgttgattgggaagctggaaatccaggctggtctccctttcttccctttttcactaaccccaagctgtcagacattgaaattagaaactgttttctagtattctaagtcctagtcctggcaaccgtgcccggccctctacagtttacatccagttaccacgctagaggctcaaggcaggcaagtttcatagtccccagttttcagatgaggagttgggattgggattggggttggtgccaaacctggaagatatcagtctctcatttttgttgttgttgttggttgcacttttcagaaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctgaacaaggcgaggcaggtgctgggtggggggattcctcccatgagaggctgcatctcagtacacagcagtgcaagtcaagctgaccatagaattatcaagttaaagagaaggaaggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatc

SEQ ID NO: 3367 - DNA, 29373 bp, human
agccctccgaagaggaccagaatgaacaccactggcagtacttcaggtgacacaagggcatcctcagaaaaaattaactgggcctggcttttctcctctttctaacctcagatatttctctttacactatttttctcttccttcctgcgtgtgccaacccccacttttagtaaaggtgcaaaaggttgagtcaattctaatcattttttccacccctcctctgggttgattgatgtgtcagtgttcttgggattctgtctgctttccccacatttaggcaatgtattgccaacataaagcctgagttgtcaagtgtctccttttcgtacaactgagcttagtgttaagagcagctcactttcagagccacacttttcccacaaaatcctgcttgtgatctagtaaataaggctcttaattcataaagagaactagaattttcatatttcaaccatgactggggtaaggcttacaccatcttagttaaataccactgctattatagtttttcaaaatacatatttgtgtacttgtgccttgtcatggtgaaccagaagatatgaagaatgtttaaccaaaaagataaagattcctctaatgcagtttgtttcttgtatccttccaagtttatgatataactatgcttaagggtggtgatgtctgggcaagcaaagtacaaactttaatgtttcttctttcctttctgtttctctaattggcatgttttcttcctgatctgattctcggtgctgatagataaatcaaatgcaaaataggcttcaactctgttctcggcactgtgagaatatctcacttccttgagggcagtggtgaaagcagtgggacatgggtcttgggatatcactaggccccgtatgtgtactgtaatgactcacatgaaattactttaagtatttaagctcactgaaatcacacttttttctacacacacatgttcatttttggagactgactttgataccagctaaattgcagaggaaaccctttcctttgaagcatgccttcaagaaggaaagtccttcaggcaaagtgtaagttattagacttgggacatgagcaaattcagattatgatatggtgttcaaggtgttatatgaagatgtgtgtctcatattcctcaaattattcaaaaccttgaccattcagggttttttttttagaaaaaattattaattaacatggaatacttctaaactttccgagattttatggcattttatctgttaatcagaatggacaaattataccagcagagaaattatcaatgatattatcaatatcattctggtatttattcattccagaatgagcacatcagtttgcttgctttatttattcatttagtgtgggatgtccacatttatctaattcctaatgaaaataaagataattctgcccattctggaagaaaaggctgtcatttgtgttcttatgagcttagccctgatgtatcaggggaatgctaaaataagatataataaaacagcataaaaaagttccagtgtcctggatcaaaagcgttataccaggtcaggagagagatacataaagtggacagtgacctggcactaggaatttcagaaagttgggggaccctaaagtcttctgaggctttaaacctgcaattaaaatcctgtacctgggccgggcatggtggctcacgcctgtaatcccagcactttgggaggccgaggtgggcagatcacctgaagtcaggagttcgagaccagcctggccaacatggtgaaacaccgtctctactaaaaatacaaaaattagccaggcatggtggtacctgcctgtagtcccagctgctcgggaggctgagtcaggggaatcacttgaacccgggagatggaggttgcagtgagctaagatcacaccagtgcactccatcctgggtgacagagtgagactccgtctcaaaaaaattcaccaaaaaaaaaaaaaaaaaaatcctgtgcctgttctttcttgctgcccagttccacaccaaaacaccctggcccattgctttacctcctcttcccagagatcagtttggttctgggctctgccccaagggtggggctctttgtaggaagccacaaggtcccgtgtcatccttggggattggtccaagaggccctcaaccctgccagaaaagtaattactaaatcgccctaaagtaaacaaccttgaataggggaaaaaaagtgcaaaacattatttgtgtctcacggccccgatctgtttttttttttttttttttttttttttttttttttttttttttttagcagcagcaagctgagaagcagctctttgtttcctttcttagaaatctcctgttctgcacttatatcagtagcaaggccctccaagagaccccaagggccttcccacactcctctgtctgtggcagggcccaggaggttcttttagactctctgctgtcaggagtttgggctgcatttcatacttggttgatatcaagtggctgccgtgaaggtcggaacttccatggcagatataggattttcctggcatcttttttctttcccccattgcccagtgttatccatgtcatccatggcacagtatcctgcctcagaatgaggaaggtgcaaggataaaaaaaaaaattgccagatgcatagagtgccagttagtatgtttctaagccaagacaactgccctggtgcttttatagtatttgttataaatgagtcctgccattttgctttttctttctgtctttagttgttgctctcaaatgtgtgagttctcaaggctatcttgatgcaagagggtataggggcaccaggattgaaagcaggtcaggactctaattaatgatattgttaaagaaaacattattctgatgtatatttaaacagtaaggcagacgttgttcaggaccatcacgattggaatagggaccactgtgatggggttttgcagcaggggagagaaacgggtcagtggatagggaagtactgagaggaaatatcaggggcaagggggattctggctaaactgacccaataggattcttgctgaagacaggcgaaggggattagacaccacctgagggattgtggggggatgaagaatccaatcagatgttggggataggccattcagatgttgggctgtggccaaaccaacttagacaatcagacatcacctgagggattgtggggggatgaagaacccaatcagatgttcggttctggccaaaccaacttagcaaacctcttgctaaaattgggctatgctgagatggacatggaagcccaaaagtcagtgcctagttgggaagtgaattcctaggagcctgactaaagtttggtcaaggagagactctttgtcaatatgcacgtgaagtatttaggggaagtattctgatgtctgcaactttatctgaatgtatccaaagaaaaagtaagatgggtgatagagaaatggatagataggtaataaggaatatacagtaaaatgttaatggtagagtctagtgatggtgggtatataggggttcactctaaagtctttcaacatctccctgtatatttgaaaaagtttataacagaatgttagagaaattaaagcaggccagggcagaagtgaggaagcagcacaaaggaagggcccagtgcagtgagacccccattttgataactgggaccacctggtgcagaaaagcaagtggacagttgccagcatgtgttgtgttccggcggccttgcttagagtgtgagcacatgggattcatcgcccctctgaccctctgggatctgaagtggtatgcgacctctttcttatgacttctgcatgacagctttcctcaccttttagctaaccactccttatgcttcgggaagatgattagcctccaggctacttgcagcctgcatggctaccatgggccaagctaatacgctctgtttttctctttgtctttctccctggtgactttcagagttggtgttgaccccgatcaagacccaccacccaacaacgacagctttcaagtcttacaaggggtaagtcacaagagatgcttcttcctggggaagacatttgagcattcgccacatgccaggcactttacctagattccctcaatgtgatcctgacaacagccttatgaagcgtgtactgctctccccattttacagattaaaagttgaagtttgggagtttgagtcatctcagaataagtgatggagccaggatttgtccccagggtatgtgttcttaatcaacattatgaagggtgtgggctcgccagaaagagtccctgactctccacttttcaatagtggatattggttctacaactggttccgagtctatcagtggtgcccaggagaaagagagcaatacgatttgactctccagcccagggatctgaggaagaaaggagagacatcaggtgcctgaaggcattcctgtttctccagggcctgggatcctctaggtgagcaatttggaaagggcatagcagggacggcttgccttttctccatgaagtccacggccccaggtgggaaaaccaggagcctggggctggaatcatgcaaaggttcatttactcatatgtctggcacctgggctggaaggacccaaccacaaggacttctgacaggaatgtctgtgcagggcttttccatgtggcctgagctgcctgccagcatggtggctgctgggtagttggatttcttatgtgatggcttaaggttccaaaagcaagtgtcccagcaagcaaggtagaggctatatcaccttttctgacctaatcttgcaagttctacagcatcacttccgtggctttctattgcttagaaatgcattcctaagaccagcccagacccaatgggaggggatagagaccataacctctggatgggaagagtatcaacaaatttacagacaagaattgaggttgccatatcatccctgttgtgcagctgtcgggatgattttgtctctaggtctggctctttatccaggtcagcatgacctgggcaggcaaggtggggaaaggagagttatgataggggcagaaatgtgttaccaatatattatttgaccttgggagtcaataactatgtcgttcagcattgaatgcccagtgctgagcacagtggctggcacatgcaggaacctgataggtgtttgttgggtggatgagggaatgagagagatgcagcatgcaacaggcagctttactgaccacctgtgtatgttgtccatgaaaccctattcttttttttccagtcagctttgaatctgactcatcattgcacttaatcctgcagcagtctgcagcagacttcacattccataggatcttctaaatgattccatctaccaaatcagatttaataaggctggcaaaatgtggtgctgtgtggggtcaatggggtgccactgtggccttttgtggtttctttctctttaagggtggccacagcctgataaggcatttatagcattgatgtccattctaggtccctgctcaagggacacaaagccatgacctggaaagttctggacattttgggaagagttttcaataagcttcattggagatttggcacccactttaatgagctccagaagacctttgagatgatcttagaattggccattatgtcagttgggagcatgtggtctcagtgagttctctttgaaaatttgctatttgactctagctttgattaaggactttagaaaacaggagttcaggaactgagcacctcgaggctaatttagagtataacagtttgggagatcttgaaactcagcctgagaaaaccccaggggaaaacatgatggccgtccttatttcaccaaaggaaagataatggctctggtaggacatggctgccctattctaaagcatcctccacagaactgtggccagtctagattaattttgtaagaaaaaaaggccaatagcagctggatcataagatttggagagatttcatcttgctctggaccattcaaaacatccccaccccctttgctgtttcccattgctcctacctctgcattcaagcatctgtaacaggaaataagtgaaaggatttggctggtcatgtagtagaacttactatgtatcacatgagccctgcgcactgggaacactgggcttgtaattagattcagtaacaagcttactgtcacttttctgtggaaatgtttgagtgagaaagcagcaggtccaaagtgctgagggttcttgtatttagtccatgcagtaacagctaaaatagcccccacccccaggtggagtgagtctcaggaacctccctggatgggcctggatggatgaactcagtgttcctgtcagctcccagagggccccttgggctgagagcaccgcacatgtggtgttgtgaacgggctggcagccactcgcgctgcactcctaatggcaccctgtttgccacagccctagccagaagctgtgtcacagcttccccctgacctccttccttccagacctcatacacagtcatgcagagggcccctcaaagtcagttccactgaccttttgaaaggttttcaagattgctgtcatatggggaaaaacatgcaaacttcaagcttggttctccaggacaccctcttagaaatgactcacgcccttgtgcagagaggaccttatttctccagttcctcctggtctgacctcctcattctagtgagccactaacagcagggctcagtgcactctgtggccatgagaaacaggaaaacagaaataaatgggcttctcatttttgggtgaaaccctgggttcttgcagtttcccctgaaatagatccaggtcacatgctcagtgttgtcatgaaactgaaatcagaggtagggaaagtccagatgtttgttctccaccagagaaaaaaaagggcggttctctttacctcattttctaaataatcttcctaaaaacaacaaacaaaaaagtgacatttgatgggaaggcatgtcttataatgagcacaattctcctcactggtcttgaagcccaaggctataaacagagtcatggctagggagctacagaatattagctcatgtgggaaaaggaagggagctgttggctagaactttgcttcatgtggggaaagcataaaaatattgtgggcagacttcagctttgtgtcccctggtaagtttgactcattagaacaaaacaagacaaaaaaaacaaaaaacaaaaaacaaaactcagtgctttgtttctctggaggtcttggtgactttgcaaccaaaacaaaaacaaccctagctggaggcaagctgcccagccctgggggtggcctcccaccccgataaagcaggggacttttcatgccagaccagacagctgagatttctgttggccgtacatgcagacacatcattcacttccttccctgagtttacagaagagcactcattgatgaggccactttggagcagctaagagtgtgaatctgaatttatcccagtttcaccatatcaacaggacaaggtcacaagccggatattaatggagtgtggaggaaaggaaaccaccaatgcctgtgtatatgcacacgtgtgtgcgtgtctgtctgtgtgtatgtagtgaaaactgtagaaaatcagcagtttattgttgcgttcacatatgactttctgagcaagttagaatcatttgtttctgggtcctccgtgtttttttttgtttgtttttgtttctccaggctgaaatctgatacccgtaaatctgtcacctaaatctttaacttcaaacagttgcagaggtgcctttcctccagttgctactctgtgaccaccgccccccccccaacccgcccatttttttgtgcttccaagtgcctcccttggcccctgatttccctttctgctcttccttttctgttttctaaaaactcagagtcaagatcaatttattcatttatttgacaaatagttattgagcacctgttctatttcaggcattctttcaggttctgggaaaatatctgcaacaaggtagatgaatctgcatcctgaagggcttggtgacaaggtgataaagggtgagggtggagagtggcagaagcaagagagtggagacactcaggcctcaccagccccactgaagcagaatctgcattttaacagtgtctccagggaatgtgtgtacattttaccattagaaaagccctgatctaggcaatgtatagctctggagagttttaagcagggaagaaaactatctgtgtatcacggtcagagatttgactctggttttttttttgttttgttttgagacagggtttccctctgacgccaaggctggagtgcagtggtgcaatcacagctcattgcagccttgacctcttgggcccgagggatcctcctccctcggcctcctgagtagctaggaccacaggtgtgtgccacttcaccaagctaatttataaaatatttttctagagacagggtcttgctttgttgcacaggctggtctcaaactcctgggctcaagtgatcttaaccctcccaaagtgcagggattacaggcatgagcccactgcctggctgattccctgtttctaaaccctattattaccctctgctgagaaatcttggatccattatcccaatgatatgacaaaggccctgtattagtccattcccacacttctataaagaaccacctgaggctgggtaatttatgaagaaaaggtttaattgactcatagttctgcaagctgtacaggaagcatagctgggaggcctcaggaaacgcacaatcatagtgaaggcaaaggggaagcaaacacatcttaccatagcggagcaggagagagagagagcaagggggaagtgccgcacacttttaaccagatctcgtgagaactcactcactatcacaagaacagcaagggggaagtctgcccccatgatccagccacctcttaccaggccccacctccaacgcttaggatcacaacttgagatgagacttgtgggggtacacagagcccaaacataccaggcccaggccgggcgtggtggctcacacctgtaatcccagcacttcgggaggccaaggcaggtggatcacctgaggtcaggagttcaagaccagcctggccaacatggcaaaaccccatctctactaaaaatacaaaaattagctgggcatggtggcaggcacctgtaatcccagctacttggaaggctgaggcaggagaatcgcttgatcccgggaggcggaggttgcagtgagccgagatcacaccactgcactgtagcctgggtgacacagcgagactccatgtccgaaaaagaaaaaaagcatatcaggcccaaatcaagtgacatcatttatttactcttctgctccatattagttgtctgtgactgctgtaacaaattaccacaaatttagtggcttaaaacaataaagttttgtttttgtttttgtttttttttaagggacagagtttcaccatgttggggctggtcttgaactccttggctcaagtgatctgcctgtcttggcctcccaaagtgctgggattataggcatgggccaccatgcccagccaaaacaatacagttttgtcatccttacagttcagtagatcagatacctggtgggctcagctggtttctctgcttcaagtttttcaaggtgttggcaaggctaagctctggggagaagccacttccaggctcattcaggttgtcagtagaattcagttccatgtggttgtaggactgaggtcctgtgttcttgctgcaaagccagcaacagtggggcaagtcaagctctgaatctctcccgccctttcttctactgcattccttcctctgactcttttgccctccatgtcctttttttttttttttttttttgagagagagacagtcttgctctattgcccaggctggagtgcagtgatgtgatctcagctcactgcaacctccacctcccaggttcaagcaattcttgtgcctcagcctcctgagtagctgggattacaggtgtgtgccaccacacccagctaatttttgtattttcagtagagaccgggtttcgccatgatggccaggctggtcttgaactcctgacctcaagtgatctgcccacctcagcctcccaaagttctgggattacaggcgtgagccactatgcctggccctccttgtccacttttaagggcccacgtgattgtcctgggcctacctggataaccttaagtccatccacaaagccttttgccaggtagtgtaacaggatccagggattaggctgtagaaagctttggtggggtggccattattctgcctaccacatgctccatccctgaaaaaaaaaaaaaaagtaagctgttcttattagtgtaatgaccttatcttttaaaaacatcttttaatattatataagaatggaatgaaatgtaactctacacagatatcattatgcattcattctagaaaaattatttcaaaaataggactgtttgctattccccagttctttaatcagctttctttttcttcattatatttgtcagtcaatatgtatttgtctgtctcccctccccctaccccccaaccctcgccaccttcaccttctggaaagagtgctccttgaggcccaggtgctaagttacattcctctttgtgtttccagcacccagcatggtgcctggcacatagtaggtgcttaatgaatgcagaagaaatagacactcattgttacatgctcaaaaaatgataataagcagggttggtggtattttcttgaaggggcttctctattaataatggcagtaaaaagatgaaaattccttgtgtaaaaagccacacaagatagccaaatgatgttaatggctaggcgtttttttcccccaaacaaatatgtgcttgaaattacatatccagtctttggaaatgaacttaattagtaatatgagctctaactacatgccagattctgggttaaatatttcacaaatatttaatcagcacaaaaagtcacatggcaaacaataatgagtcaatatttgttgagtgcttgccacatatcagacaccatcctaagttctttaaatgaaaaatcttttacagttctaaaattaaaacctattttctctacattcacaccacttttaatgccaaatatgtagggtctttttgtataccagccagttctccaattcccaatgagtaccaactggacctcctacagtttaactcactacgtacctggagttagcgtcagatcccacaggttaaggactcagtcccacaagactgtccccacttcagacaccagttgcaagtcccaggtcgtgacctgtacttcagactgactggctataggggggggttcccaacccctcctcaggttcgataatttgctagaatgactcacagaacacaacttttaccattaccagtttgttataaaggatacaactcggaaatagcctaatggaagagatgcatagggcaaaggatggggatgggagtatgtggcgccaacttggaagccctccaaattgtgtcatttagggttttatggaggtttcattacataggcatggttgattaaattagtagccattggtaattaactcaatccccagtcctcccctcctaggaggttgggatggggctaaaagttccaatcctctaattacatggttggtttctctggcaatcagtgtccattcaagagtcaccttattagcataaattcaggtgtgcttgaaaggagcttattattaataaaaaaagatgttcctcccaccccatctactcaggaaattccaagggttttaggagttttatgtcagacaaaaaccagatatatatttcttgttctatcacaacattacagcctcataatgcccctagaggtaggtaattattaatatttccagtttacagatgaggatactgaagcacagaaaggttaggtaacttgcccagcatcacacagcaagacaatggcagcggcacagtcaggagccagatagtctcttgagagagcctgtgatatccacacctacacttcttggagtgctatgtcgcttttgaaacatttcttagagaagccacgcttctgcacaggcttgaaaggtgaatagaggttggccgggtaggtgttctgggtgggagaaggtgagaggaaaaaagaatgctccaggccctagaagttgcctgagctgaagacatgaggtgcgaacccaggttttgaggaggggcgagttgagagagcaagtctgtgctttttctgtggacggcacaggagtggaaaatccaagagtcgccaagtacagccaggaaggaggctccgcctgttcccacagtgacccttcctcagtccggtgctgttcggagcccacaggaagggctctcaatggcttctctgtgacagcagccccaatcatgtcatgaagcagttattgcttgtcttccgggtcagctttaaaaaattagttctgtcccacagaactgccctgatttccccaaagccaccatatgtggatttatctaagttcttcctatacctaatcatgcttctggcaccatctcttggaataagaagttgtttaacacccttttcacaaagttacacctttgatttgtcctgaatttaccccttgtagcctctaagcgttgtttcttagttcttacatttcgggatttgctgtggagtctgaggtcactttatcttattcatggattgcaggcatatctttccgtagcctgagaagaccttttgttagtttgctgtcaaaccattcccttgctttactcattttaattgtcttttttggggcttatataagtctcttgtagctttctttttttaaatttaacttttaacttccggggttcttgtagctttcttgagattaaatggcaagaaattaagtagtccagtgataataaatgctttgtggttttgcagaggttaagatgacagagtagggttcattgttttcatcattgatttaagggaagaagcggaagaaactgactttggggtactcgttttgtgcctgatggtttaatagtatccttcctgatgatgtttatcgttgtgctggctttttccttagtaaaattctacaggcacttagaactgagaacttagagcctattactttataaagaaccatttgattttttccattatatatttgcctatcaaaaaagtcatctgctacttttctactcagtcatgtggcattttggaatcttcccagagttgtcattgggttagcaatcagtcaccctgcaaatggaggcatttctgtgctctctctcttgctcatgatttataaaaatgtaaaatcaaattggtctctggggtctctccttgtttatatttcctcatccacagaagggcccatttaactgagccatttccatatccatcactaaacattcctgaaataccgaggggattcaatttttaaaaataatctttgctgttggaaactttaggagtgtattaataaatagtgcttgctaatttctctccttctcttgtctatgtgcttctcaaagatctttgattaattatttgatgttgccattgcgggtagaatttacattcaccatgatttaaaactacttgtaattttggttcaagttgtatttggtgattgtcaattgtccctcacttgcagagttgcctctccctgtaatattaaagagaatgatgataataatagcttcacaagcagtctgtgcttgcacagccctagtagtaccctcaaattgctgcagtcagtctgagttttatattaactgtgctgcttctgatacttgcacagaacagatttcctaaacctcaaatgaatgtttgattttgcaggttattttgaaagttacacgatggggatgtttaaactggaagggcatgagagtagcaaggaacttgctacttgatggtagataaaataacagaattgttagttcgagctcgtttctcctgcccactgatcccaccttcctaaagctggtggggaaacaagtaccttaccacctggagcacagtgtaggtccctgggtaaggaccacagagaagccttaactagtttgtcaggatactcaacaatatgtggtttccacaggcctactttggggatgaggattggaaagttgcttttacaaaaagcttttaaaaatattcgctataaatcaattttggcctgttagtatctagagtattttagggtaattaatctgctgaaagacactttgaggaaaattgcaataagaatgccaaaagaaatgttgttccatattaagtttgagctatccacaggcataacccagcctttttactttggagactgatttttctgccttttgagtttaatttctgctcaaatgctacctcccaatatatctttgaaactttgctgacatgggatgtttgactatgagctccagagctatacaagttattaaaaaaggttttttttcccctttctttgagatcccttttgtacaactaagcatgtgccctcttgtttgttcctaggacggcccagattctgccagaggaaaccggacaaaacaggagagcgcatggatattcaggctgtggtacagctttgatcacaagtatccttttaagtagcatcccctgtgtcggtgaaacattggggatgaaatcttgttgaattgtcggtgaatgacacctgataagtaaggaaagatgcatgcttgggacagggatagcccatcctcttatggaacgtgtgcattgagcattcaaccataggtagtcctggtgagtatctctctggccaagaggaatgtttgcatatccttagagtaaccagcccacagcctggtagactcatgtggctcttaagagctttgtgtccagggaactatgcctttttaggtgattagattaaaattacgcaatgaatcgtgctgtggtcagaaaaggaagtagaacttcagctgttaatccatatggggaggataattcctattggatgaactcggccaagtctgatcttgtatgatctgatactggcataactgggccacatgcagggcaaaccctgttccagtagattcacttggtctcaagtgaaaattaaaaaccaaaatgttaaaccctcatggttttttttgtttgttttgtttgtttgtttgttttttgtttttgagatgaggtctcactccattgcccaggctggagtgtggtggcgcactcagctcactgcaaccttcccctcccaggctcaagcaatctcccacctcagcctcccaagtagctgggaccacaggtgcatgccaccgcacccagctaattttttgtatttttggtagagatagggtttcgccatattgcccaggctggtctcgaactcctgggctcaagcaatctgcccacctcagcctcccaaggtgctgggattacaggcatgagccacttcacccaacccctcatggtttcttaagttgacatagtcatcaaatgggcaggtggcttattatatatggtctttggagacgccaaaactgttaaaaatttattgaagtatagtagatatacagaaaagtacacaaataataagtgctcagtaaattatcagaaaataaacacactcatttaacaccaaacgaatcaagaaacaaaattccaaggctgggcatagtagctcatgcctttagtcccagtactttgggaggccaaggcaggtggatcacttgagcccaggaattatagaccagcctgggcaacatgatgaaaccctgtctctacaaaaaatacaaaaattagtcaggtatggtggcacacacctgtagtccagctacttgggccctgtctccaaaaaaaaaaaaagaaagaaagaaaattgccaaacccctcatgccatgactcaattactaccccttccccctccccaaatgtaattgctctgttgacttctagcaacacttaatagttttacctgtttttcaactttctgtaaataggattatacagtatatatattttagtgtctggcttatttggcttgacattatgtgtataatacagccatgttgttatgtgtagttctagttcatttgttctccttgttccatagtatttcttatataaatatatcacaatttattctattattgatgtacatgtcttttgatgtacatatacatattttttttggtaatctacccaggagtaacattgctgggtaataggacatgggtaggttcaactttagaagatagtgccagttttccaaaatagtggtactactttacacagtcacttctagcatatgagagttccagttactccacatcctaccaacatttggtgttgtcagtctttttaattttagccattctattgggtttgtagtggtatttaatcatggctttaatttgcatttctcagatgactgatagggttgagcacctttgcatatatttactggccatttggtatgtttctttgtgaagtgcctgttcaagtcttttgcccatttttctattgagttgtctgcctttttcttactgatttgtaagagttctttgtgcattctggatatgagtcttttgctgatcatacatgataaaaatatctgctaccactttgtaacttgccttttcactttttttttttttttgagacagagtctcactctgtcacccaggctggagtgcagtggtgtgatctcaactcactgcagcctcttcctcccgggttcaagtgattctcatgccttagcctcccgagtagctgggattacaggcacacaccactacacctggctaatttttgtatttttagtagataggaggttttaccatgttgcccaggctggtctggaactcctggcctcaagttatccacctgccttggcctcccaaagtgctgggattacaggcgtgagccaccatacccagcctcactttttaaatagaatattttgatgaacaaaaggtcttaatccaatgtattgatctcctagttagtattttttatgtcctgtttcagaaatctttgcctaccccaaagtcatgaagccaatttcctatgttatcttctagaagctttattgttggtcttctgtgcatctctttttttttactgagtgacaagcatgggcaattttttctctagaaaaaaaatctagagataatttgagatgctctgcctaacatcatcatccttcagagatgatttaagcttatatctgatcagtggctaggctaggggtattagcaattgcagatcactttaatccaaacaggaataaggatgatttgatgctgggccctagttcctgtgagagttagtcttgactgttttctctttaccctttattctaggatccccacctaaagcctggtttccatcttcttcctcagtaggccctggactttcttttttgtcaggttcactctatctttgtgactctgccaaatgctctgctctgtttcttaggtgcctttagggaaactgtggctcaccaaccacagggctcacctctttggtttcctcctctcaaattccacccctcttcactgccttggtagctttctgaagccttcaagcagatggttttgtcttattttattttgtctagcttttctagttgttctcagtggaaaggttggttcaaattaccttgtttgctactaactgaagtagaacccccagggatttttcaagccatgtggactattagaatccagaatgcatattgcctgctggtctcagaaaggatgtaaagaaaatggaagagtatccaccaggagagtgacacagtgctaaagtgagaaactgatcctctgaagaggaacaggagttatctctaaagtttcatctgaatctaaattttagtgactttgggatttccactttttagtttggaaaaaaactaaaaaggagagaaaactgtaatgtaagacaaaggtaagtcttgagccaatttgtccagatgattttattaaagaatgttaagaacagctgcaacaggtacttcctgtgtcaacagatcaattggtagctgctaattttttcttcaagccacagatacctaaagaaagttagagacactacctggagagggcttggtagagaaacagatcttgagggcatcaaagatttttctcttgagagtcactccccacccaactttggccatggtaggagtctgtacctgcctgatgaagagaaaaactaaatagagacatgagggactaattaaacaattatgtactttttgattaatccttagagagttgaaaggctttttcagtcatgatactagagaagattattagaaaaaggagtaaatcaaacaaaaaattcttgaaaattaaaaacaaggtttctgaaattaaccaaaaaaatgtaatggatagctaataacttgaatatgatgaagaccaaattgttgatctggaagatagagttgagaaaaaaaaagtccaataattatagcaaaaagaaacatgtaagaggagagtttcaagatatggaggtcagaatcagttggtccaaatcatttgacaggatctgaaaggagaggacagagactttggaggaaaagtaccaaagaaataatggaagaaaaattcccttagctaagaaagacagttgtttccagagtgcaagggcccaccaagtgtgagtaggttgaatggacacgttcgggggcattccataactacaagagaaaaagagggaatctttgaggtttccaaagataaaaacaagcaacctccaaaaagcaagaatcagacttctcatcgacaaaattggttgttagaatacagttgagcaatgtcttcaaagttctaggatgaaaaaaagaagtctgaacctagaattctacacccaaactgtcaatcaaaaataagagaatgaaggagggtagctttcagacatgtaaaaattcagaaagtttagcaccatgcagaccctgtaagaaggaagaaaaataacataaagatcaaacaaaacaaaatccagcaaaggggacagtgattgttataactcagaagaagtgaacaaagtcaaaaagaaaagatcttttatttggcaagatactcaagggttctcttctgactgacaaaatttaaatgacagtgtgttacatttccttttatattgctccaaccactttgcttggttctccagagaacagcattcatgcaatgatgttatattacaaatgctgcttactggtttttgtttttttgtttttgttttgtttttttttgggggggtgggttttttttttttttgagacagggtctcactctgcactgatcatgcagtggcacgatcataactcactgcagccttgacctccctaggctcaagtgatcctcccaccttagcctcccaagtagctagcatgtgtcaccacaccctgctaatttttgcttttttttttttttttaagagatgaggtttcaccatgttgcccaggctggtcttgaatttctgggctcaagccatctgcctgccttagcctcgcaaagtgctgggattacatgcctgagccactgcatccagtctgcttactggtttttaacacttagactcaatctatacacaaagcataaaaaatctacttattagttataaagtagaaagcaaatgttatatatctccagtataaagttaattataataaaaattgggaagaaaaaattggaaaaaagagacaggagtgtaaatgagttaaacgtaccatccttactaggaaggaaaagcctcagactaaagtttataaatcaagaaatgggggagaagtgtattatctaaagttgtaatgtaattaccagaacaactagagtgggatagaaagacttgatgttttattttgtcccatccaacaatttgaatatttaaaaacatatatatagcttactggttatatatatatatatatatgtatatgtatatacacatatttcttttctttttttgaagaagttgtcatggggccttctggagaggaggaagggggagcttgtctttggagtacctgaggtggagaactgaaaagcagtctctgagttcccctggcctcctgcgtatttgtcattctacagatctgagcctctgtcatcttctgagccaaagacacaagaaaactgacaggcctgtagggtctcttcccaaattggaggagcgcctggtctgcatctctccctgggaatgtggttcaaggacagcaaaggggagctggttccgcgtataaagagctccaggccgggcgcgttggctcacgcctgtaatcccagcattttgggaggccgaggcgagtggatcacgaagtcaagagatcgagaccatcctgaccaacatggtgaaaccctgtctctactaaaaatacaaaaattagctgggtatggtggcacgcgtctgtagtcccagctacttgggaggctgaggcaggagaattgcttgaatctgggaggcggaggttgcagtgagccaacatctcaccactgcactccagcctggcaacagagcgagactccgtctcaaaaaaacaaaacaaaaaacagagctccagccaggcctgcacatcctctttggttgagtaatttcaaactagaagcatgctccagtgtctcccttccatctcctcctctagagagagctgcttttctcttgtgctgctctaaatgaaaacagaaagtgaggggtgatgctcccagcagtcatcctgttaggtacagatggcggtggcatctcctcaactttctttgaagtctcttggccatccctgtagtggaagtggccatctgagaccccaccttttccacactgcttaggctgtaggtttcagaagtggtcccggctgtatcaaaatgtggctggtgcttcatggagcttcccacatagggctgtgcgtttggtagcgctgatattcaccaagtgacagacaagcaagataagctctctgcttatccgttgaccttcatgttagagcagtggacaagtttgcttcccaggggacatttggcaattttttgaagacattttttattgtcacaacttggagaggggagtaacggtgctactggcatctacagacagtccccaacttaagatgcttcaacttaggatctttcaactttacgatatagtgtgaaattgatctgcattcagtagaaaccatactttgagtacccatacaaccatcctgtttttcattttcagtacagtatgtaataaattacatgagatattcaatactttattataaaacaggctttgtgttagatgatgttgcccaactgtaggctaatgttagtgttctgagcacatttgatgtaacctgggctaagctgtgatgtttggtaggttaggtgtgttaaatgcatttttggcttatgatattttcaacctaatgggcttattgggatgtaactgcatcataagtcgaggggcatctgcagtgtgtagagatcagggatgctgctcaatatcctaccatacacagaatagccccccataacaaagaatgatctggccctaaatgtcaatagtgttgaggttgaaaagccttgtgttagcgtctaggagagaagctgtgggtagagtgaagaatggtcctgtatgggaagttgagagacttacagtccgagtaaccttactgaaatcatttcatgttgccaagtctcaatttctgcctttatagtagccccaggctacctctaaggtcctgtccaacttcagcatttccaccacctgccctctgggtagagtggtttaacaggaatccatgcagagaacaagagcagaggggacacaggggctgcaactccccactccagggacactatctcctgtttccaaggcctggagccagttgtgtgtcagaggctgaaatgctgattgaaaccaaaacttccattcaacatgacaaagggagaagggggatctaatttctaattaatcaaatacacgtttgaactgaaaattgggaattaccaacctgagagttaacagttactatttaaggctgatagggcgtatcttactctttgattcaaactgttgcatgttacaagtatttcgtgtgttgtacgagtaaaatggggaaaagaaggtttttgtgggtggaatgtcgggcaattttttaagcacattttgttgtgtatatgttttctttgcagccatttttccttaattcacattttaaagttacctgaagcccatcctcacacacagtggtcccccactaaccaccacgctccccgcctggtgtggcttactagctcgatgtctgaccagtccccaggtgtacgatgtaagtactgcacatcagggttggagtcctggtcaccatgccagggtagtgtcttacgtaggaagaagaaaccatcatactcatgcctccaaatccacagatttttgcttctctaataagctgattagaaatggccatcttccatatgtttatagatttcgcatagtaacagagaaagcttttaccagggtaatgggattcccccacatcggccgctgtggtgtagtagaagaacactggatttggaatcagagccactggattggaatgcaacccctgacaggccatagatgtgctctgcatctcagttctttctctctctctttttttttttttttttttttttttttttttttttttttttgagacggagtctcactctgtcgcccaggctggagtgcagtggtacaatctcggctcactgcaacctatgcctcccgggttcaagcagttctctgcctcagcctcccaagtagctgggattacaggcgcctgccaccacaccgggctaatttttgtatttttagtagagacagggtttcaccatgttggccaggctggtcttgaactcctgacctcgtgatccacccacctcggcctcccaaagtactgggattacaggcgtgagccaccatgcccggcctgcatctcagttttctaatctataaaatgggcctagtagtacaggctggctgggagcattaaatgatgaaatacatgaagatacactgaaccacaaagcatgcaaggattccttttctaaatagtttatttatgttgatatggttaggtcctttctttccattttcagattatagaaatagactcagcacagtatgaaaagaacatgtacactggtggacgtcttagatttagggctgactcctgcactcctggtgtgggttgcagggtacagggcagagaggtagagagagcaaggtagctacccacgtggaaggagtagaggagaggtcagaggccttccttcatccctcttcggccatcctaatcatcttgtcactaacacagtcattatgccctagaagaaaagaatttctaaaatttgcgtacagctctagagttcacaaaggctaagttcattcgttgggtcataccatgaatcagtgagtactgcagcattacagagaaggaaagtgcatctcagagaggatgtgagttggccccgggcccacagttagtaattagctgggaccctcatgcaggtcttcacattcttagcaaataacctgcagtttacttgattggtgatgagaaggcagaacacaaagcctagatctgaaagagaacggccctaaacaggtaagttctaacgaggggtagcagggttaggaaaggcagtgcacattcatgtggtatagaggggaaagggatgtggacaccatagctaggtgggggcgctggggcggaagagaagggcagccacatcagagcagccgagattggaggatgcagctccttaaatggcacgctcttccttcaagaacagggatgacaactgccaagtcaccatgtgtcctaaacccgctgctgcagagagctctgtgtgtctgtcatccctaggccctcggacctctccttggccccctcagaggaaggtgaccattgaaaagtcctggtaggcagcgacagaactttacactgggaaactcagctgggctactgggtttcacccccttcacagcaggttctgcctggtaaaaatgtagttctgccacagccgttgcttggaaatttcaccaaatgtggcagtagcgttcatgtgtctttctcttaaagatagttgaacttccaacacccacggctcctccccatataaaaatgaaattcctgtgccacctgtgataaactggttttaaatgacaaaaaaatatgtaggatggtgagaacaccatttctgtagaactgctcccagtttgtaaagtgatgtctaatgcttgcggtaagttttaaatgtaatatctatcagcctaaataataatgctagttacctgttaggttagaaggacacaaaccaatagattaaaaacttagttttgtaatttctcatcctgctactagcttacttaagaaaagctgtcttgtgctgaatgctgaatggtttgctcagtttggcccgctgtctaaagtggtagtaggggccctttacatacatcatcggagacaaagggtgctgacggcatttccacttctcccactaatgaagccccaactgtgattacactttctgatcttaagtttcactgggtttatatatataaatttgtcttctaactctagtctcttctaaacactttgtaaaactttccatcttaattgggttttaataaggatcacttttcatgtctatgtaatagtaaaacaacaaatccactattaaaactttataaaaaccttatctaatctgaagcttactaaccagtcccttgctcatagattaggaatatctggactagtttgaactcagcataaactcagtaagcttacaattgcatcaatttcaagtgcttctcccagcagttcaagggaccactccaagtttgcttctgggggtcatgtttcagctgtgactccccacagccaacctaagactgagtgacttgggcttctagtgagaatcaccctcggtcctgctgctgctgctgctttgagccggggtcctgcctagggtctcagccagctccagacatggtggggcctgctgctgagacagtgggagcaaagggtctcttcaaaattatcagtggaggaacccaaaactgacagaggtgaaggggctcactgcaaagtttagtgcctggtgagggtctcagactgggcagttctcgtagattttgacacctgttgcatggttcttacccaccatctaaaaggtgttttctactttgccaagtttatttggagatttctaagatgttcatcagtcattatttccactaacgttaaaccacttaggtgtggtatccagcttcctaacaatgttctttcacttttgaaaatgacttctggttatttaaaatgcacacatccccacacactgttgtttgcaggtgttttcactgcattttcatagcagacttaattgcacagctagttacatgattatatagaccttcagcgtaacaaaacaaacttgtgttgatcctatcatctagaattcaagggagcaggttagttttatcatctgcatgtaacattattagactttgatgtcagaatcactctccatgggttgtttgttttttgagacagtctcgctctcttgcccaggctgcagtgcaatggtatcatcttgacccactgcaacctctgcctcccgggttcaagcgattctcgtgcctcagcctcccgagtagctgggattacagctgcgtgccactatgcctggctaatttttgtattttttgtagagacatggtttcaccatgttgagcaggctggtctcgaattcctgacctcaagtgatccgctcgcctcggcttcccaaagtactgggattacagatgtgagccaccatgcctggcctctccatgggtttttttttgttttcttttgttttgttttgttttttgagacagagtcttgctctgtcacccaggtgggagtgcagtggtgcaatcttggcttgctgcaacctctgcctccccaattcaagcaattctcctgcctcagcctcctgagtagctgggattacaggtgcccaccaccaccacccggctaatttttgtatttttaatagagatggggtttcaccacgttggccaggctggtctcgaacccctgacctcgtgatccaccctccttggcctcccaaagtgctgggattacaggcgtgagccaccgcacccagcctccgtgggttttactatggccttgtttctgaatgacctttccttgagtactatgtctgggcttgggagtttcagaaatgcaatgggttgacatccagtcttgttttctcctgtcagtgaatttaggccctgcttccctctgcaaagagtgaaagcggaccacatcacagttcatgcccagggtttcctctgtggtgctgtggtgggctttccttcatttgcggaattaccctcacctgcagttatcctgtgtttgcctctgtccttccatggctccaaaccttgaagcagtaaaatatgtgccaggaccatttccctgaaaactgggagccaagagccctggcagagagattttgacagagatgaacaaaatcattatgtagcacgtgtatgaatgggagaattgggatgtgccgagacagggaaggtgaactccccaggagttggaaattcggatgggagacataagctaccggctgggtgtggtgactcacgcctgtaatgccagcactttgggaggctgaggtgggaggatcacctgaggtcaggagtttgagactagcctgaccaacgtggtgaaattccatctctactaaaaatacaaaaattagctgggcatgatggtgggcacctgtaatcacagctactcaggaggctgaggcaggagaattgcttgaacctgggaggtggaggttgcagagagccaagattgcaccattgcactccagcctgggtggcaagagtgaaactccatctcaaaaaataaaaagaaaaagaaagaaggctactgtaaagcagattgagtttcgggactttctaaacactggtaaagaggaggaaatttgggagtttaaatcaagttttagaactgtgctctgagcatctgcctgaatataggacttttatctcattgggcatttgcaccctgcttcattccagtgaggatttgaagcagcaagtgagaggagttgcgtgcttgcctgtcaaaaatgctgaagcattagttaagtggagtcacagtgtagactgtgtgtagggaagttgacaacactgagaatgcagaaaacaagtatgtgattgttgccagtgagtgcacagaaataagtctgggagaggaaacgcaacccatgagtcttccctagctggtgcatttacctggcattcacttagcacctactgtgaggtaagcaccattgaggaaggtgccaaggtgtggagaaggaggtcactgccctttggcgtttgtcatctagatggggctgatctcggggaatctgcccatggccttgggcagtgtgactgcgcgggggccctgagggggtcagagaggccagttcggcgccctggaggctctgtctcataagaggatgcaggacttcagatgagctttgaagggtcggtgggaaacaggagagaaaaaatcagtttacccagcgtatttgacactgtgtttgcccttctagaaggcagtgcacagtactcaataggcctcagtgcagcgcgggagctgggttgtggccctccccttgttttgttggttaaatctattggaggaagaaggtcctgtctgacctcgtgccgtctccgacactctcgctaccatctgatagttcaagtggttgcaactttgctctccctcgatcatttgattcatccacctgaggatgtggcgggtgggcttcctatcagggttttcctgtggggagatgacaggggaaacagggaggaaatcctgattatggcttgtcctcttccctgaattgctgtctatgacaaagagtagttccaatgtaaacaagacgggttggagacggtttgtatagggcaggagacccacccggaatgcctacccagagaagacagtacctgaaacctatttgcaacgtttgcccaattaccctactctggccttgctttgtgtgttgattgggaagctggaaatccaggctggtctccctttcttccctttttcactaaccccaagctgtcagacattgaaattagaaactgttttctagtattctaagtcctagtcctggcaaccgtgcccggccctctacagtttacatccagttaccacgctagaggctcaaggcaggcaagtttcatagtccccagttttcagatgaggagttgggattgggattggggttggtgccaaacctggaagatatcagtctctcatttttgttgttgttgttggttgcacttttcagaaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctgaacaaggcgaggcaggtgctgggtggggggattcctcccatgagaggctgcatctcagtacacagcagtgcaagtcaagctgaccatagaattatcaagttaaagagaaggaaggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatccataaagaagtagttatgaaatgtttaaaaccaa
